United States Patent
Naesby et al.

(10) Patent No.: US 9,828,617 B2
(45) Date of Patent: Nov. 28, 2017

(54) GENES AND PROCESSES FOR THE PRODUCTION OF CLAVINE-TYPE ALKALOIDS

(71) Applicants: BASF SE, Ludwigshafen (DE); Evolva SA, Reinach (CH)

(72) Inventors: Michael Naesby, Basel (CH); Christophe Folly, Basel (CH); Curt Aimé Friis Nielsen, Reinach (CH); Anaelle Hatsch, Wittisheim (FR); Markus Schwab, Loerrach (DE); Oskar Zelder, Speyer (DE); Stefan Haefner, Speyer (DE); Hartwig Schroeder, Nussloch (DE); Birgit Hoff, Pfungstadt (DE); Andrea Molt, Weinheim (DE); Klaus Ditrich, Goennheim (DE); Michael Breuer, Darmstadt (DE); Holger Hartmann, Schwetzingen (DE); Karsten Koerber, Eppelheim (DE)

(73) Assignees: BASF SE, Ludwigshafen (DE); Evolva SA, Reinach (CH)

( * ) Notice: Subject to any disclaimer, the term of this patent is extended or adjusted under 35 U.S.C. 154(b) by 0 days.

(21) Appl. No.: 14/421,872

(22) PCT Filed: Aug. 13, 2013

(86) PCT No.: PCT/IB2013/056604
§ 371 (c)(1),
(2) Date: Feb. 16, 2015

(87) PCT Pub. No.: WO2014/030096
PCT Pub. Date: Feb. 27, 2014

(65) Prior Publication Data
US 2015/0211036 A1 Jul. 30, 2015

Related U.S. Application Data

(60) Provisional application No. 61/786,841, filed on Mar. 15, 2013, provisional application No. 61/691,848, filed on Aug. 22, 2012.

(30) Foreign Application Priority Data

| Aug. 22, 2012 | (EP) | 12181388 |
| Mar. 15, 2013 | (EP) | 13159444 |
| Jul. 25, 2013 | (EP) | 13178008 |

(51) Int. Cl.
*C12N 15/53* (2006.01)
*C12P 17/12* (2006.01)
(Continued)

(52) U.S. Cl.
CPC .............. *C12P 17/12* (2013.01); *C07D 209/90* (2013.01); *C07D 487/06* (2013.01); *C07K 16/40* (2013.01);
(Continued)

(58) Field of Classification Search
None
See application file for complete search history.

(56) References Cited

U.S. PATENT DOCUMENTS

2007/0117198 A1  5/2007  Valik et al.

FOREIGN PATENT DOCUMENTS

| CN | 101238208 A | 8/2008 |
| WO | 2012/116935 * | 9/2012 |
| WO | WO-2012/116935 A2 | 9/2012 |

OTHER PUBLICATIONS

Coyle et al, An ergot alkaloid biosynthesis gene and clustered hypothetical gene from *Aspergillus fumigatus*, Appl. Environ. Microbiol., 71:3112-8 (2005).
(Continued)

*Primary Examiner* — Rebecca Prouty
(74) *Attorney, Agent, or Firm* — Marshall, Gerstein & Borun LLP

(57) ABSTRACT

Microorganisms and processes for the recombinant manufacture of clavine-type alkaloids such as cycloclavine, festuclavine, agroclavine, chanoclavine and chanoclavine aldehyde, as well as polypeptides, polynucleotides and vectors
(Continued)

comprising such polynucleotides which can be applied in a method for the manufacture of clavine-type alkaloids are provided.

3 Claims, 45 Drawing Sheets

(51) Int. Cl.
| | |
|---|---|
| C12N 9/02 | (2006.01) |
| C12N 9/90 | (2006.01) |
| C12N 15/52 | (2006.01) |
| C12P 17/10 | (2006.01) |
| C12P 17/18 | (2006.01) |
| C07D 209/90 | (2006.01) |
| C07D 487/06 | (2006.01) |
| C07K 16/40 | (2006.01) |
| C12N 9/10 | (2006.01) |

(52) U.S. Cl.
CPC .......... *C12N 9/001* (2013.01); *C12N 9/0004* (2013.01); *C12N 9/1007* (2013.01); *C12N 9/1085* (2013.01); *C12N 9/90* (2013.01); *C12N 15/52* (2013.01); *C12P 17/10* (2013.01); *C12P 17/182* (2013.01); *C12Y 205/01* (2013.01)

(56) References Cited

OTHER PUBLICATIONS

Fleetwood et al., A complex ergovaline gene cluster in epichloe endophytes of grasses, Appl. Environ. Microbiol., 73(8):2571-9 (2007).
Flieger et al, Ergot alkaloid glycosides from saprophytic cultures of claviceps, J. Nat. Products, 53:171-5 (1990).
Florea, "Towards elimination and genetic manipulation of ergot alkaloid production in fungal endophytes", University of Kentucky Doctoral Dissertation, Paper 803 (Dec. 31, 2009).
GenBank Accession No. AEV21243.1, putative oxygenase [Claviceps fusiformis], Dec. 7, 2011.
GenBank Accession No. FJ594412, Neotyphodium coenophialum putative oxygenase (easH) gene, complete cds, Feb. 4, 2009.
GenBank Accession No. JN182233.1, Claviceps fusiformis strain SD58 putative oxygenase (easH) gene, complete cds; and EF-hand 1 calcium binding protein pseudogene, complete sequence, Dec. 7, 2011.
Goetz et al., Ergot cluster-encoded catalase is required for synthesis of chanoclavine-I in *Aspergillus fumigatus*, Curr. Genet., 57(3):201-11 (2011).
Haarmann et al, Ergot: from witchcraft to biotechnology, Mol. Plant Pathol., vol. 10:563-77 (2009).
Haarmann et al, The ergot alkaloid gene cluster in *Claviceps purpurea*: extension of the cluster sequence and intra species evolution, Phytochemistry, 66:1312-20 (2005).
Hulvova et al., Parasitic fungus Claviceps as a source for biotechnological production of ergot alkaloids, Biotechnology Advances, 31:79-89 (2013).
Inglis et al, Comprehensive annotation of secondary metabolite biosynthetic genes and gene clusters of *Aspergillus nidulans, A. fumigatus, A. niger* and *A. oryzae*, BMC Microbiol., 13:91 (2013).
International Preliminary Report on Patentability, International Application No. PCT/IB2013/056604, dated Feb. 24, 2015.
International Search Report and Written Opinion, International Application No. PCT/IB2013/056604, dated Feb. 6, 2014.
Lorenz et al., Alkaloid cluster gene ccsA of the ergot fungus Claviceps purpurea encodes chanoclavine I synthase, a flavin adenine dinucleotide-containing oxidoreductase mediating the transformation of N-methyl-dimethylallyltryptophan to chanoclavine I, Appl. Environ. Microbiol., 76(6):1822-30 (2010).
Lorenz et al., Comparison of ergot alkaloid biosynthesis gene clusters in *Claviceps* species indicates loss of late pathway steps in evolution of C. fusiformis, Appl. Environ. Microbiol., 73(22):7185-91 (2007).
Markert et al., Biosynthesis and accumulation of ergoline alkaloids in a mutualistic association between Ipomoea asarifolia (Convolvulaceae) and a clavicipitalean fungus, Plant Physiol., 147:296-305 (2008).
Partial European Search Report, European Patent Application No. 12181388.5, dated Apr. 10, 2013.
Rigbers et al., Ergot alkaloid biosynthesis in Aspergillus fumigatus. Overproduction and biochemical characterization of a 4-dimethylallyltryptophan N-methyltransferase, J. Biol. Chem., 283(4):26859-68 (2008).
Ryan et al, Partial reconstruction of the ergot alkaloid pathway by heterologous gene expression in Aspergillus nidulans, Toxins, 22:445-55 (2013).
Ryan et al, Partial reconstruction of the ergot alkaloid pathway in aspergillus nidulans, Mycologia: Supplement Inoculum, 63(3): abstract (2012).
Schardl et al., Ergot alkaloids—biology and molecular biology, Chapter 2, IN: The Alkaloids, vol. 63, 46 pp. (2006).
Tsai et al, The Claviceps purpurea gene encoding dimethylallyltryptophan synthase. The committed step for ergot alkaloid biosynthesis, Biochem. Biophys. Res. Commun., 216:119-25 (1995).
Tudzynski et al, Biotechnology and genetics of ergot alkaloids, Appl. Microbiol. Biotechnol., 57:593-605 (2001).
Tudzynski et al, Evidence for an ergot alkaloid gene cluster in *Claviceps purpurea*, Mol. Gen. Genet., 261:133-41 (1999).
Unsold et al., Overproduction, purification and characterization of FgaPT2, a dimethylallyltryptophan synthase from Aspergillus fumigatus, Microbiology, 151(pt. 5):1499-505 (2005).
Wallwey et al., Ergot alkaloids: structure diversity, biosynthetic gene clusters and functional proof of biosynthetic genes, Nat. Prod. Rep., 28(3):496-510 (2011).
Furuta et al., "Isolation of Cycloclavine from the Culture Broth of *Aspergillus japonicus* SAITO", Agric. Biol. Chem., 46(7):1921-1922 (1982).
Supplementary European Search Report in EP 13 83 1449 dated Mar. 18, 2016.
Office Action, Chinese Patent Application No. 201380054217.4, dated Sep. 29, 2016.

\* cited by examiner

Figure 3a:
DmaW sequence alignment (part 1)

DmaW sequence alignment (part 2)

Figure 3c:
DmaW sequence alignment (part 3)

Figure 3d:
DmaW sequence alignment (part 4)

EasF sequence alignment (part 1)

Figure 4b:
EasF sequence alignment (part 2)

EasF sequence alignment (part 3)

EasE sequence alignment (part 1)

Figure 5b:
EasE sequence alignment (part 2)

EasE sequence alignment (part 3)

EasE sequence alignment (part 4)

Figure 5e:
EasE sequence alignment (part 5)

EasC sequence alignment (part 1)

Figure 6b:
EasC sequence alignment (part 2)

EasC sequence alignment (part 3)

Figure 6d:
EasC sequence alignment (part 4)

EasD sequence alignment (part 1)

EasD sequence alignment (part 2)

Figure 8:
EasH sequence alignment

Figure 9a:
EasA sequence alignment (part 1)

Figure 9b:
EasA sequence alignment (part 2)

Figure 9c:
EasA sequence alignment (part 3)

Figure 9d:
EasA sequence alignment (part 4)

```
                                                             Section 7
                                                (409) 409              420
  >EasA_Aspergillus flavus NRRL3357_SeqID 038 (371) ------------------
>EasA_Penicillium chrysogenum Wisconsin 54-1255_S... (369) ------------------
      >EasA_Neurospora tetrasperma_SeqID 039 (381) ------------------
      >EasA_Aspergillus terreus NIH2624_SeqID 040 (368) ------------------
          >EasA_Claviceps fusiformis_SeqID 035 (380) VAA---------------
           >EasA_Claviceps purpurea_SeqID 037 (370) ------------------
       >EasA_Periglandula ipomoeae_SeqID 034 (380) A-----------------
         >EasA_Neotyphodium lolii_SeqID 033 (380) A-----------------
       >EasA_Aspergillus fumigatus_SeqID 032 (377) ------------------
       >EasA_Aspergillus japonicus_SeqID 002 (401) REAAATGSICQG------
    >EasA_Paecilomyces divaricatus_SeqID 031 (379) T-----------------
                                    Consensus (409)
```

Figure 10a:
EasG sequence alignment (part 1)

Figure 10b:
EasG sequence alignment (part 2)

Figure 10c:
EasG sequence alignment (part 3)

GENES AND PROCESSES FOR THE PRODUCTION OF CLAVINE-TYPE ALKALOIDS

CROSS-REFERENCE TO RELATED APPLICATIONS

This is the U.S. national phase of International Application No. PCT/IB2013/056604, filed Aug. 13, 2013, which claims the benefit of U.S. Provisional Application No. 61/691,848, filed Aug. 22, 2012, and U.S. Provisional Application No. 61/786,841, filed Mar. 15, 2013, each incorporated herein by reference in its entirety, and European Patent Application No. 12181388.5, filed Aug. 22, 2012, European Patent Application No. 13159444.2, filed Mar. 15, 2013, and European Patent Application No. 13178008.2, filed Jul. 25, 2013

FIELD OF THE INVENTION

The invention in principle pertains to the field of recombinant manufacture of clavine-type alkaloids such as cycloclavine, festuclavine, agroclavine, chanoclavine and chanoclavine aldehyde. It provides microorganisms and processes for the manufacture of clavine-type alkaloids as well as polypeptides, polynucleotides and vectors comprising such polynucleotides which can be applied in method for the manufacture of clavine-type alkaloids.

BACKGROUND OF THE INVENTION

Ergot alkaloids are a complex family of indole derivatives with diverse structures and biological activities (Flieger 1997, Folia Microbiol (Praha) 42:3-30; Schardl 2006, Chem Biol 63:45-86) and are produced by fungi of the families Clavicipitaceae (e.g. *Claviceps* and *Neotyphodium* or *Epichloee*) and Trichocomaceae (including *Aspergillus* and *Penicillium*). Important natural producers are fungi of the genera *Claviceps, Penicillium*, and *Aspergillus* (Flieger 1997, loc cit.; Schradl loc cit.), but they are also found in the genus *Sphacelia, Balansia* or *Periglandula* (Pažoutová, S. et al, 2008, Fungal Diversity, 31: 95-110 and Steiner, U. 2011, Mycologia, 103(5):1133-1145). Both the natural ergot alkaloids and their semisynthetic derivatives are in widespread use in modern medicine and exhibit a broad spectrum of pharmacological activities, including uterotonic activity, modulation of blood pressure, control of the secretion of pituitary hormones, migraine prevention, and dopaminergic and neuroleptic activities (de Groot 1998, Drugs 56:523-535; Haarmann 2009, Mol Plant Pathol 10:563-577; Schardl 2006, loc cit.) Ergot alkaloids can be divided into two classes according to their structural features, i.e., amide derivatives of D-lysergic acid and the clavine-type alkaloids (Flieger 1997, loc cit.) Gröger 1998, Alkaloids Chem Biol 50:171-218). The members of the first group are usually composed of lysergic acid and a peptide moiety. They are also referred to as ergopeptines. Important members of the ergopeptines are for example ergotamine and ergovaline. The clavine-type alkaloids like cyloclavine, agroclavine, fumigaclavine and similar substances, like elymoclavine, pyroclavine, costaclavine or epcostaclavine as well as their precursors chanoclavine-I and chanoclavine aldehyde merely consist of the same or a similar tricyclic or tetracyclic ring system, like the ergopeptines, but lack a peptide moiety. However, clavine-type alkaloids may also comprise additional substituents and are thus not limited to the clavine-type alkaloids mentioned above. Examples of such derivatives are the group of fumigaclavines, like fumiclavine A, B or C, isofumigaclavine A or B, or 9-deacetylfumigaclaine C (Wallwey, C. and Li, S. M. 2011, Nat. Prod. Rep., 28:496-510) share the basic structure with festuclavine, but comprise additional substituents. Fumigaclavines are for example produced by *Penicillium* and *Aspergillus*, e.g., *A. fumigatus* (Flieger 1997, loc cit.). The fungal family of the Clavicipitaceae e.g. *C. purpurea* (Flieger 1997, loccit), however have the capacity to produce ergopeptines, which can be considered to be derivatives of lysergic acid, of one of which precursors is the clavine-type alkaloid agroclavine. Comparison of the precursors of ergopeptidens and clavine-type alkaloids indicated that the early stages of their biosynthetic pathway are very similar and likely shared for example by *A. fumigatus* and *C. purpurea*, whereas later steps in the pathway differ in the two fungal species (Li 2006, Chembiochem 7:158-164; Panaccione 2005, FEMS Microbiol Lett 251:9-17; Schardl 2006, loc cit.).

The fermentative production of clavine-type alkaloids and even ergot alkaloids in general has to cope with the problem that natural producers of ergot alkaloids tend to be hard to culture in large scale. One reasons for this are technical problems of fermenting filamentous fungi in submerse culture. Some natural ergot alkaloid producers are even endophytes of plant genera like *Ipomoea, Turbina, Argyreia* and *Strictocardia* (e.g. *Periglandula* species) or of certain grass species, like *Lolium, Sorghum* or *Festuca* (e.g. *Neotyphodium* and *Epichloe* species). Further, many natural ergot alkaloid producers produce these alkaloids only under specific conditions or during certain developmental stages, even then they usually produce at a low production rate. Many natural ergot alkaloid producers produce a collection of different ergot alkaloids which causes problems to isolate a given alkaloid in a cost effective manner and lowers the production of a particular alkaloid of interest even further. The total chemical synthesis of ergot alkaloids or even of the less complex clavine-type alkaloids does, so far, still represent a considerable challenge and results usually in the synthesis of racemic mixtures.

In order to overcome these problems, the present invention provides recombinant microorganisms and recombinant natural ergot alkaloid producer organisms, as well as polynucleotides, polypeptides, vectors and methods using these recombinant microorganisms and recombinant natural ergot alkaloid producer organisms, as well as polynucleotides, polypeptides and vectors for the production of clavine-type alkaloids.

SUMMARY OF THE INVENTION

The invention provides for recombinant microorganisms comprising:
a) at least one EasH activity, or
b) at least one EasH and EasD activity, or
c) at least one EasH and EasA reductase activity, or
d) at least one EasH, EasD and EasA activity, or
e) at least one EasH and EasD, EasA reductase and EasG activity, or
f) at least one DmaW, EasF, EasE, EasC, EasD, EasH, EasA and EasG activity, or
g) at least one EasD, EasA and EasG activity, or
h) at least one DmaW, EasF, EasE, EasC, EasD, EasA reductase and EasG activity, or
i) at least one DmaW, EasF, EasE, EasC, EasD, EasA isomerase and EasG activity, or
j) at least one DmaW, EasF, EasE and EasC activity,
k) a combination of at least two of a) to j)

wherein the recombinant microorganism is not a natural ergot alkaloid producer organism.

The invention provides further recombinant natural ergot alkaloid producer organism having at least one up-regulated activity selected from the group of activities consisting of: DmaW, EasF, EasE, EasC, EasD, EasH, EasA and EasG activity, wherein the EasA activity is an EasA reductase, an EasA isomerase or an EasA reductase and EasA isomerase activity.

The recombinant natural ergot alkaloid producer organism comprise at least one up-regulated activity selected from the activities of one or more of the groups of:
a) at least one EasH activity, or
b) at least one EasH and EasD, or
c) at least one EasH and EasA reductase activity, or
d) at least one EasH, EasD and EasA activity, or
e) at least one EasH and EasD, EasA reductase and EasG activity, or
f) at least one DmaW, EasF, EasE, EasC, EasD, EasH, EasA and EasG activity, or
g) at least one EasD, EasA and EasG activity, or
h) at least one DmaW, EasF, EasE, EasC, EasD, EasA reductase and EasG activity, or
i) at least one DmaW, EasF, EasE, EasC, EasD, EasA isomerase and EasG activity, or
j) at least one DmaW, EasF, EasE and EasC activity.

Further are provided recombinant natural ergot alkaloid producer organism as described above having at least one down-regulated activity selected from the group of EasD, EasH, EasA reductase, EasA isomerase and EasG activity. Another embodiment of the invention are recombinant microorganism or recombinant natural ergot alkaloid producer organism as described herein comprising an enlarged supply of DMAPP and/or an enlarged supply of Me-DMAT, preferably comprising at least one down-regulated ERG9 or ERG20 activity, or at least one up-regulated HMG-CoA reductase activity, or comprising at least one down-regulated ERG9 or ERG20 activity and at least one up-regulated HMG-CoA reductase activity.

Other embodiments of the invention comprise recombinant microorganism or recombinant natural ergot alkaloid producer organism as described above comprising at least one recombinant polynucleotide coding for:
a) at least one EasH activity, or
b) at least one EasH and EasD activity, or
c) at least one EasA reductase or at least one EasA isomerase activity, or
d) at least one EasD, EasA isomerase and EasG activity, or
e) at least one EasD, EasA reductase and EasG activity, or
f) at least one EasH, EasD, EasA reductase, EasA isomerase and EasG activity, or
g) at least one EasH, EasD, EasA reductase and EasG activity, or
h) at least one EasH, EasD, EasA isomerase and EasG activity, or
i) at least one DmaW, EasF, EasE and EasC activity
j) a combination of at least two of a) to i).

The invention provides also recombinant polynucleotides coding for:
a) at least one EasH activity, or
b) at least one EasH and EasD activity, or
c) at least one EasA reductase or at least one EasA isomerase activity, or
d) at least one EasD, EasA isomerase and EasG activity, or
e) at least one EasD, EasA reductase and EasG activity, or
f) at least one EasH, EasD, EasA reductase, EasA isomerase and EasG activity, or g) at least one EasH, EasD, EasA reductase and EasG activity, or
h) at least one EasH, EasD, EasA isomerase and EasG activity, or
i) at least one DmaW, EasF, EasE and EasC activity
j) a combination of at least two of a) to i).

Further are provided recombinant microorganism or recombinant natural ergot alkaloid producer organism as described above, or a recombinant polynucleotide as described, wherein the DmaW activity is due to
a) a polypeptide comprising an amino acid sequence having at least 90% sequence identity to SEQ ID NO: 145 and 146, or
b) a polypeptide comprising an amino acid sequence having at least 90% sequence identity to SEQ ID NO: 147 or 190, or
c) a polypeptide comprising an amino acid sequence having at least 40% sequence identity to SEQ ID NO: 1, 19, 20, 179, or 180, or
d) a polypeptide comprising an amino acid sequence having at least 90% sequence identity to SEQ ID NO: 1, 19, 20, 21, 22, 23, 24, 25, 26, 27 or 28, or
e) a polypeptide encoded by a polynucleotide having at least 70% sequence identity to SEQ ID NO: 102, 122 or 123, or
f) a polypeptide encoded by a polynucleotide having at least 70% sequence identity to SEQ ID NO: 129 or 137, or,
g) a polypeptide encoded by a polynucleotide obtainable with two PCR-Primers, each comprising at least 15 consecutive nucleotides of a polynucleotide sequence selected from the group of sequences described by SEQ ID NO: 102, 122 or 123, or
h) a polypeptide encoded by a polynucleotide which hybridizes under stringent conditions to SEQ ID NO: 102, 122 or 123, or
i) a polypeptide according to at least two of a) to h), preferably according to at least b) and c), or a polypeptide according to at least one of a) to i) which is obtainable from a natural ergot alkaloid producer organism.

Further embodiments comprise recombinant microorganism or recombinant natural ergot alkaloid producer organism as described herein, or a recombinant polynucleotide as described above, wherein the EasF activity is due to
a) a polypeptide comprising an amino acid sequence having at least 90% sequence identity to SEQ ID NO: 154, or
b) a polypeptide comprising an amino acid sequence having at least 40% sequence identity to SEQ ID NO: 6, 75 or 76, or
c) a polypeptide comprising an amino acid sequence having at least 90% sequence identity to SEQ ID NO: 6, 75, 76, 77, 78, 79, 80, 81, 82, 83, 84 or 85, or
d) a polypeptide encoded by a polynucleotide having at least 70% sequence identity to SEQ ID NO: 107 or 120, or
e) a polypeptide encoded by a polynucleotide having at least 70% sequence identity to SEQ ID NO: 134 or 142, or,
f) a polypeptide encoded by a polynucleotide obtainable with two PCR-Primers, each comprising at least 15 consecutive nucleotides of a polynucleotide sequence selected from the group of sequences described by SEQ ID NO: 107 or 120, or
g) a polypeptide encoded by a polynucleotide which hybridizes under stringent conditions to SEQ ID NO: 107 or 120, or
h) a polypeptide according to at least two of a) to g), preferably according to at least a) and b), or i) a polypeptide according to at least one of a) to h) which is obtainable from a natural ergot alkaloid producer organism.

Other parts of the invention comprise recombinant microorganism or recombinant natural ergot alkaloid producer organism as described above, or a recombinant polynucleotide as described above, wherein the EasE activity is due to
a) a polypeptide comprising an amino acid sequence having at least 90% sequence identity to SEQ ID NO: 153, 185 or 191, preferably having at least 90% sequence identity to SEQ ID NO: 191, or,
b) a polypeptide comprising an amino acid sequence having at least 40% sequence identity to SEQ ID NO: 5 or 64, or
c) a polypeptide comprising an amino acid sequence having at least 90% sequence identity to SEQ ID NO: 5, 64, 65, 66, 67, 68, 69, 70, 71, 72, 73 or 74, or having at least 90% sequence identity to SEQ ID NO: 5, 64, 175, 66, 67, 68, 69, 176, 71, 177, 73 or 178, or
d) a polypeptide encoded by a polynucleotide having at least 70% sequence identity to SEQ ID NO: 106, or
e) a polypeptide encoded by a polynucleotide having at least 70% sequence identity to SEQ ID NO: 133 or 141, or,
f) a polypeptide encoded by a polynucleotide obtainable with two PCR-Primers, each comprising at least 15 consecutive nucleotides of a polynucleotide sequence selected from the group of sequences described by SEQ ID NO: 106, 133 or 141 or
g) a polypeptide encoded by a polynucleotide which hybridizes under stringent conditions to SEQ ID NO: 106, 133 or 141 or
h) a polypeptide according to at least two of a) to g), preferably according to at least a) and b), or
i) a polypeptide according to at least one of a) to h) which is obtainable from a natural ergot alkaloid producer organism.

Further parts comprise recombinant microorganism or recombinant natural ergot alkaloid producer organism as described above, or a recombinant polynucleotide as described above, wherein the EasC activity is due to
a) a polypeptide comprising an amino acid sequence having at least 90% sequence identity to SEQ ID NO: 151 or 192, or,
b) a polypeptide comprising an amino acid sequence having at least 40% sequence identity to SEQ ID NO: 3 or 41, or
c) a polypeptide comprising an amino acid sequence having at least 90% sequence identity to SEQ ID NO: 3, 41, 42, 43, 44, 45, 46, 47, 48, 49, 50, 51 or 52, or
d) a polypeptide encoded by a polynucleotide having at least 70% sequence identity to SEQ ID NO: 104, or
e) a polypeptide encoded by a polynucleotide having at least 70% sequence identity to SEQ ID NO: 131 or 139, or,
f) a polypeptide encoded by a polynucleotide obtainable with two PCR-Primers, each comprising at least 15 consecutive nucleotides of a polynucleotide sequence selected from the group of sequences described by SEQ ID NO: 104, 131 or 139, or
g) a polypeptide encoded by a polynucleotide which hybridizes under stringent conditions to SEQ ID NO: 104, 131 or 139, or
h) a polypeptide according to at least two of a) to g), preferably according to at least a) and b), or a polypeptide according to at least one of a) to h) which is obtainable from a natural ergot alkaloid producer organism.

The invention comprises further recombinant microorganism or recombinant natural ergot alkaloid producer organism as described above, or a recombinant polynucleotide as described above, wherein the EasD activity is due to
a) a polypeptide comprising an amino acid sequence having at least 90% sequence identity to SEQ ID NO: 152, or,
b) a polypeptide comprising an amino acid sequence having at least 40% sequence identity to SEQ ID NO: 4 or 53, or
c) a polypeptide comprising an amino acid sequence having at least 90% sequence identity to SEQ ID NO: 4, 53, 54, 55, 56, 57, 58, 59, 60, 62 or 63, or
d) a polypeptide encoded by a polynucleotide having at least 70% sequence identity to SEQ ID NO: 105, or
e) a polypeptide encoded by a polynucleotide having at least 70% sequence identity to SEQ ID NO: 132 or 140, or
f) a polypeptide encoded by a polynucleotide obtainable with two PCR-Primers, each comprising at least 15 consecutive nucleotides of a polynucleotide sequence selected from the group of sequences described by SEQ ID NO: 105, 132 or 140, or
g) a polypeptide encoded by a polynucleotide which hybridizes under stringent conditions to SEQ ID NO: 105, 132 or 140, or
h) a polypeptide according to at least two of a) to g), preferably according to at least a) and b), or a polypeptide according to at least one of a) to h) which is obtainable from a natural ergot alkaloid producer organism.

Other parts of the invention comprise recombinant microorganism or recombinant natural ergot alkaloid producer organism as described above, or a recombinant polynucleotide as described above, wherein the EasH activity is due to
a) a polypeptide comprising an amino acid sequence having at least 90% sequence identity to SEQ ID NO: 156, or
b) a polypeptide comprising an amino acid sequence having at least 60% sequence identity to SEQ ID NO: 8 and/or 95 and having at least 90%, 91%, 92%, 93%, 94%, 95%, 96%, 97%, 98%, 99%, or 100% sequence identity to SEQ ID NO: 156, or
c) a polypeptide comprising an amino acid sequence having at least 90% sequence identity to SEQ ID NO: 8 and/or 95, or
d) a polypeptide encoded by a polynucleotide having at least 70% sequence identity to SEQ ID NO: 109, and/or 157, or
e) a polypeptide encoded by a polynucleotide having at least 70% sequence identity to SEQ ID NO: 109, 136, 144 and/or 157, or,
f) a polypeptide encoded by a polynucleotide obtainable with two PCR-Primers, each comprising at least 15 consecutive nucleotides of a polynucleotide sequence selected from the group of sequences described by SEQ ID NO: 109, 136, 144 and/or 157 or
g) a polypeptide encoded by a polynucleotide which hybridizes under stringent conditions to SEQ ID NO: 109, 136, 144 and/or 157 or
h) a polypeptide according to at least two of a) to g), or
i) a polypeptide according to at least one of a) to h) which is obtainable from a natural ergot alkaloid producer organism.

Further embodiments comprise recombinant microorganism or recombinant natural ergot alkaloid producer organism as described above, or a recombinant polynucleotide as described above, wherein the EasA reductase activity is due to a) a polypeptide comprising an amino acid sequence having at least 90% sequence identity to SEQ ID NO: 148, 149 and 150 and having tyrosine at amino acid position 18 of SEQ ID NO: 149, or
b) a polypeptide comprising an amino acid sequence having at least 40% sequence identity to SEQ ID NO: 2 or 31, or
c) a polypeptide comprising an amino acid sequence having at least 90% sequence identity to SEQ ID NO: 2, 31, 32, 33, 34, 35, 36, 37, 38, 39 or 40, or
d) a polypeptide encoded by a polynucleotide having at least 70% sequence identity to SEQ ID NO: 103, or
e) a polypeptide encoded by a polynucleotide having at least 70% sequence identity to SEQ ID NO: 130 or 138, or,
f) a polypeptide encoded by a polynucleotide obtainable with two PCR-Primers, each comprising at least 15 consecutive nucleotides of a polynucleotide sequence selected from the group of sequences described by SEQ ID NO: 103, or
g) a polypeptide encoded by a polynucleotide which hybridizes under stringent conditions to SEQ ID NO: 103, or
h) a polypeptide according to at least two of a) to g), preferably according to at least a) and b), or
i) a polypeptide according to at least one of a) to h) which is obtainable from a natural ergot alkaloid producer organism.

Alternative embodiments comprise recombinant microorganism or recombinant natural ergot alkaloid producer organism as described above, or a recombinant polynucleotide as described above, wherein the EasA isomerase activity is due to
a) a polypeptide comprising an amino acid sequence having at least 90% sequence identity to SEQ ID NO: 148, 149 and 150 and having phenylalanine at amino acid position 18 of SEQ ID NO: 149, or
b) a polypeptide comprising an amino acid sequence having at least 40% sequence identity to SEQ ID NO: 2 or 31, or
c) a polypeptide comprising an amino acid sequence having at least 90% sequence identity to SEQ ID NO: 2, 31, 32, 33, 34, 35, 36, 37, 38, 39 or 40, or
d) a polypeptide encoded by a polynucleotide having at least 70% sequence identity to SEQ ID NO: 103, or
e) a polypeptide encoded by a polynucleotide having at least 70% sequence identity to SEQ ID NO: 130 or 138, or,
f) a polypeptide encoded by a polynucleotide obtainable with two PCR-Primers, each comprising at least 15 consecutive nucleotides of a polynucleotide sequence selected from the group of sequences described by SEQ ID NO: 103, or
g) a polypeptide encoded by a polynucleotide which hybridizes under stringent conditions to SEQ ID NO: 103, or
h) a polypeptide according to at least two of a) to g), preferably according to at least a) and b), or
i) a polypeptide according to at least one of a) to h) which is obtainable from a natural ergot alkaloid producer organism.

Further embodiments comprise recombinant microorganism or recombinant natural ergot alkaloid producer organism as described above, or a recombinant polynucleotide as described above, wherein the EasG activity, is due to
a) a polypeptide comprising an amino acid sequence having at least 90% sequence identity to SEQ ID NO: 155 or 183, preferably having at least 90% sequence identity to SEQ ID NO: 183, or,
b) a polypeptide comprising an amino acid sequence having at least 39% sequence identity to SEQ ID NO: 7 or 86, or
c) a polypeptide comprising an amino acid sequence having at least 70% sequence identity to SEQ ID NO: 7, 86, 87, 88, 89, 90, 91, 92, 93 or 94, preferably having at least 70% sequence identity to SEQ ID NO: 7, 86, 87, 88, 89, 90, 181, 92, 93 or 94, or
d) a polypeptide encoded by a polynucleotide having at least 70% sequence identity to SEQ ID NO: 108, or
e) a polypeptide encoded by a polynucleotide having at least 70% sequence identity to SEQ ID NO: 135 or 143, or
f) a polypeptide encoded by a polynucleotide obtainable with two PCR-Primers, each comprising at least 15 consecutive nucleotides of a polynucleotide sequence selected from the group of sequences described by SEQ ID NO: 108, or
g) a polypeptide encoded by a polynucleotide which hybridizes under stringent conditions to SEQ ID NO: 108, or
h) a polypeptide according to at least two of a) to g) preferably according to at least a) and b), or
i) a polypeptide according to at least one of a) to h) which is obtainable from a natural ergot alkaloid producer organism.

The invention provides further for recombinant microorganism or recombinant natural ergot alkaloid producer organism as described above, wherein the ERG9 activity is due to a polypeptide comprising an amino acid sequence having at least 70% sequence identity to SEQ ID NO: 9, or wherein the ERG20 activity is due to a polypeptide comprising an amino acid sequence having at least 70% sequence identity to SEQ ID NO: 10, or wherein the HMG-CoA reductase activity is due to a polypeptide comprising an amino acid sequence having at least 70% sequence identity to SEQ ID NO: 11, or wherein at least two of the ERG9, ERG20 and HMG-CoA reductase activities are due to polypeptides comprising an amino acid sequence having at least 70% sequence identity to SEQ ID NO: 9, 10 or 11, or wherein the ERG9, ERG20 and HMG-CoA reductase activity are due to polypeptides comprising an amino acid sequence having at least 70% sequence identity to SEQ ID NO: 9, 10 and 11. Further embodiments comprise recombinant microorganism comprising at least one compound selected from the group of compounds of
a) Cycloclavine,
b) Festuclavine,
c) Agroclavine,
d) Chanoclavine aldehyde,
e) Chanoclavine I,
wherein the recombinant microorganism is not a natural ergot alkaloid producer organism.

The invention provides also for recombinant natural ergot alkaloid producer organisms comprising and/or producing at least one of the compounds selected from the group of: Cycloclavine, Festuclavine, Agroclavine, Chanoclavine aldehyde and Chanoclavine I to a higher amount as compared to the non-recombinant wild-type organism when grown under the same conditions. Further embodiments comprise recombinant microorganism or recombinant natural ergot alkaloid producer organism as described in any one of parts and embodiments of the invention described above comprising at least one compound selected from the group of compounds of
a) Cycloclavine,
b) Festuclavine,
c) Agroclavine,
d) Chanoclavine aldehyde,
e) Chanoclavine I.

Other parts of the invention comprise recombinant expression cassettes for expression of at least one polynucleotide encoding a polypeptide as described in any one of the parts and embodiments of the invention, or a polynucleotide comprising at least one of such expression cassettes. Further parts of the invention are methods for the production of at least one of Cycloclavine, Festuclavine, Agroclavine, Chanoclavine aldehyde or Chanoclavine I comprising:
a) cultivating a recombinant microorganism or recombinant natural ergot alkaloid producer organism as described above under conditions which allow the production of at least one of Cycloclavine, Festuclavine, Agroclavine, Chanoclavine aldehyde or Chanoclavine I in the recombinant microorganism or recombinant natural ergot alkaloid producer organism; and
b) obtaining said Cycloclavine, Festuclavine, Agroclavine, Chanoclavine aldehyde and/or Chanoclavine I from the recombinant microorganism or the recombinant natural ergot alkaloid producer organism and/or the culture medium.

Other methods of the invention provide for the production of at least one of Cycloclavine, Festuclavine, Agroclavine, Chanoclavine aldehyde or Chanoclavine I, comprising:
a) cultivating a recombinant microorganism or recombinant natural ergot alkaloid producer organism as described above under conditions which allow for the production of at least one of Cycloclavine, Festuclavine, Agroclavine, Chanoclavine aldehyde Chanoclavine I in the recombinant microorganism or recombinant natural ergot alkaloid producer organism;
b) providing said recombinant microorganism or recombinant natural ergot alkaloid producer organism with at least one of the compounds selected from the group of IPP, Tryptophan, DMAPP, DMAT, Me-DMAT or Chanoclavine I via the culture medium, and
c) obtaining said Cycloclavine, Festuclavine, Agroclavine, Chanoclavine aldehyde or Chanoclavine I from the recombinant microorganism or the recombinant natural ergot alkaloid producer organism and/or the culture medium.

Variants of the methods described above comprise methods wherein Cycloclavine is produced and obtained, or wherein Festuclavine is produced and obtained or wherein Agroclavine is produced and obtained, or wherein Chanoclavine I is provided to the medium and Cycloclavine is produced and obtained, or wherein Chanoclavine I is produced and obtained, or wherein Chanoclavine aldehyde is produced and obtained. The methods as described above may employ different cultivation temperatures. Accordingly, further parts of the invention comprise methods, wherein in the recombinant microorganism or recombinant natural ergot alkaloid producer organism is cultivated at a temperature between 10° C. to 40° C., preferably between 15° C. to 35° C., more preferred between 18° C. to 32° C., even more preferred between 20° C. to 30° C. The methods may employ recombinant microorganism or recombinant natural ergot alkaloid producer organism cultivated at a temperature between 10° C. and 32° C., between 13° C. and 32° C., between 15° C. and 32° C., between 16° C. and 32° C., between 17° C. and 32° C., between 18° C. and 32° C., between 19° C. and 32° C. between 20° C. and 32° C., between 15° C. and 31° C., between 15° C. and 30° C., between 15° C. and 29° C., between 15° C. and 28° C., between 15° C. and 27° C., between 15° C. and 26° C., between 15° C. and 25° C. Variants of these methods comprise changes in cultivation temperature. Accordingly, the invention provides for methods as described above, wherein the recombinant microorganism or recombinant natural ergot alkaloid producer organism is first cultivated at a temperature between 25° C. and 40, preferably between 25° C. and 35° C., followed by a temperature between 10° C. and 25° C., preferably between 15° C. and 25° C., or wherein the recombinant microorganism or recombinant natural ergot alkaloid producer organism is first cultivated at a temperature between 10° C. and 25° C., preferably between 15° C. and 25° C., followed by a temperature between, 25° C. and 40, preferably between 25° C. and 35° C. The invention provides also for methods as described above, wherein at least one of the produced Cycloclavine, Festuclavine, Agroclavine, Chanoclavine aldehyde or Chanoclavine I, is obtained via extraction. These methods comprise methods wherein at least one of Cycloclavine, Festuclavine, Agroclavine, Chanoclavine aldehyde or Chanoclavine I is obtained via an extraction method comprising extraction with a compound selected from the group of: Ethyl Acetate (EA), Tert-Butyl MethylEther (TBME), Chloroform (CHCl3) and Dichloromethane (DCM) and methods wherein at least one of Cycloclavine, Festuclavine, Agroclavine, Chanoclavine aldehyde or Chanoclavine I is obtained via an extraction method comprising Liquid/Liquid Extraction with Ethyl Acetate at pH=10, preferably a Liquid/Liquid Extraction with Ethyl Acetate at pH=10 wherein the pH is adjusted with NaOH. Further variants of these methods comprise methods wherein at least one of Cycloclavine, Festuclavine, Agroclavine, Chanoclavine aldehyde or Chanoclavine I is obtained via an extraction method comprising extraction with a Solid Phase Extraction with silica based resin material, preferably selected from the group of HLB resin at pH=3, Diaion resin at pH=3, Amberlite 1180 resin at pH=3, Amberlite 1180 resin at pH=10, Amberlite 16N resin at pH=3 or Amberlite 16N resin at pH=10. Further parts of the invention comprise the use of a recombinant microorganism or recombinant natural ergot alkaloid producer organism as described above or the use of a recombinant polynucleotide as described above, or of a vector as described above for the production of at least one compound selected from the group of Cycloclavine, Festuclavine, Agroclavine, Chanoclavine aldehyde or Chanoclavine I or in any method being described above. The invention comprises further Cycloclavine, Festuclavine, Agroclavine, Chanoclavine aldehyde or Chanoclavine I, produced by any of the methods described above. Other parts of the invention are culture media produced in a method as described above, comprising at least one of Cycloclavine, Festuclavine, Agroclavine, Chanoclavine aldehyde or Chanoclavine I, but no or a low content of other ergot alkaloids, culture medium comprising at least one of Cycloclavine, Festuclavine, Agroclavine, Chanoclavine aldehyde or Chanoclavine I, but no or a low content of other ergot alkaloids. The invention provides further for additional polynucleotides which can be used in any of the parts and embodiments of the invention described above.

Accordingly, the invention comprises polynucleotides comprising one or more nucleic acid sequences selected from the group consisting of:
a) a nucleic acid sequence having a nucleotide sequence as shown in SEQ ID NO: 129, or 130, 131, 132, 133, 134, 135 or 136;
b) a nucleic acid sequence encoding a polypeptide having an amino acid sequence as shown in SEQ ID NOs: 20, 31, 41, 53, 64, 75, 86 or 95;
c) a nucleic acid sequence being at least 70% identical to the nucleic acid sequence as shown in SEQ ID NO: 129, or 130, 131, 132, 133, 134, 135 or 136, wherein said nucleic acid sequence encodes a polypeptide having DmaW, EasF, EasE, EasC, EasD, EasH, EasA reductase, EasA isomerase or EasG activity;

d) a nucleic acid sequence encoding a polypeptide having DmaW, EasF, EasE, EasC, EasD, EasH, EasA reductase, EasA isomerase or EasG activity and having an amino acid sequence which is at least 70% identical to the amino acid sequence as shown in SEQ ID NOs: 20, 31, 41, 53, 64, 75, 86 or 95; and e) a nucleic acid sequence which is capable of hybridizing under stringent conditions to any one of a) to d), wherein said nucleic acid sequence encodes a polypeptide having DmaW, EasF, EasE, EasC, EasD, EasH, EasA reductase, EasA isomerase or EasG activity.

Further parts of the invention comprise polynucleotides described above, wherein said polynucleotides further comprise at least one nucleic acid sequence coding for a polypeptide as described in any part or embodiment of the invention described above. Further embodiments of the invention comprise vectors or expression cassettes comprising these polynucleotides and vectors comprising these expression cassettes and/or comprising an expression cassette for any one of the polypeptides described in this invention. Further encompassed by the invention are expression vectors for expression of any one of the polypeptides comprised by the invention and host cells comprising such a vector or comprising a polynucleotide encoding at least one polypeptide described above. These host cells may be bacterial cells, fungi cells, in particular filamentous fungi cells, or yeast cells. The invention provides further for methods for the manufacture of a polypeptide encoded by a polynucleotide as described above, comprising a) cultivating a host cell as described above or a *Paecilomyces divaricatus* cell under conditions which allow for the production of the said polypeptide; and b) obtaining the polypeptide from the host cell of step a).

Accordingly, the invention comprises polypeptides which are encoded by the polynucleotides described above, or which are obtainable by the method for production of such polypeptides. Other parts of the invention comprise antibodies which specifically bind to the polypeptides described above. Further embodiments of the invention comprise methods for the manufacture of Cycloclavine, Festuclavine, Agroclavine, Chanoclavine aldehyde or Chanoclavine I, or for the manufacture of a combination of these, comprising:

a) cultivating a host cell as described above or a *Paecilomyces divaricatus* cell under conditions which allow for the production of at least one of Cycloclavine, Festuclavine, Agroclavine, Chanoclavine aldehyde or Chanoclavine I in said host cell; and b) obtaining at least one of Cycloclavine, Festuclavine, Agroclavine, Chanoclavine aldehyde or Chanoclavine I from said host cell or *Paecilomyces divaricatus* cell or the cultivation medium.

The invention does also comprise the use of a polynucleotide as described above, or a vector as described above or a host cell as described above or a *Paecilomyces divaricatus* cell for the manufacture of at least one of the compounds selected from the group of Cycloclavine, Festuclavine, Agroclavine, Chanoclavine aldehyde and Chanoclavine I.

BRIEF DESCRIPTION OF THE DRAWINGS

FIG. 2 does also name some exemplary natural ergot producer organisms producing clavine-type alkaloids. Such natural ergot producer organisms are *Aspergillus japonicus* (*A. japonicus*) in the case of Cycloclavine, *Claviceps purpurea* (*C. purpurea*) in the case of Agroclavine and *Aspergillus fumigatus* (*A. fumigatus*) in the case of Festuclavine.

Figure 3A:
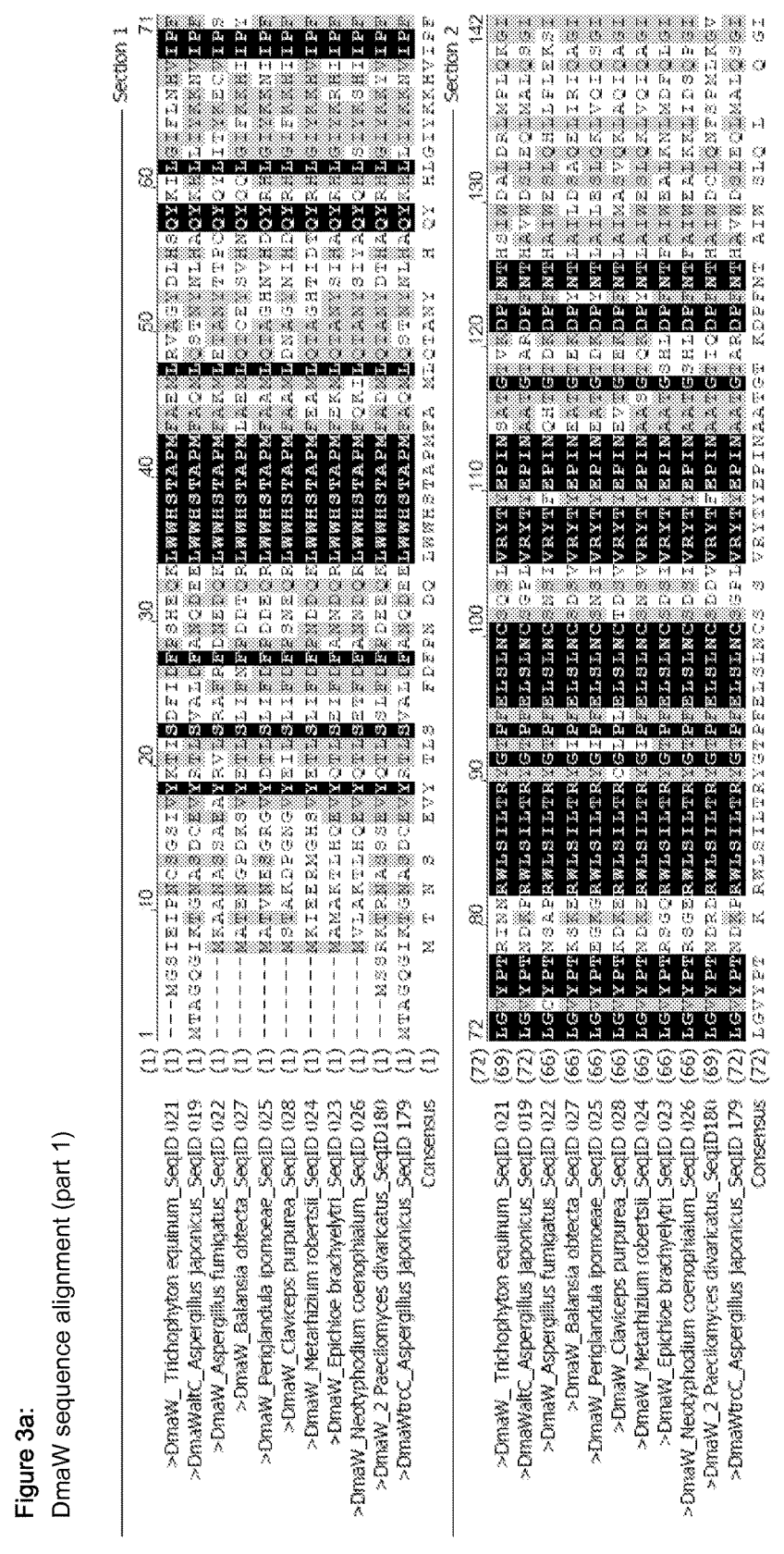
Figure 3C:
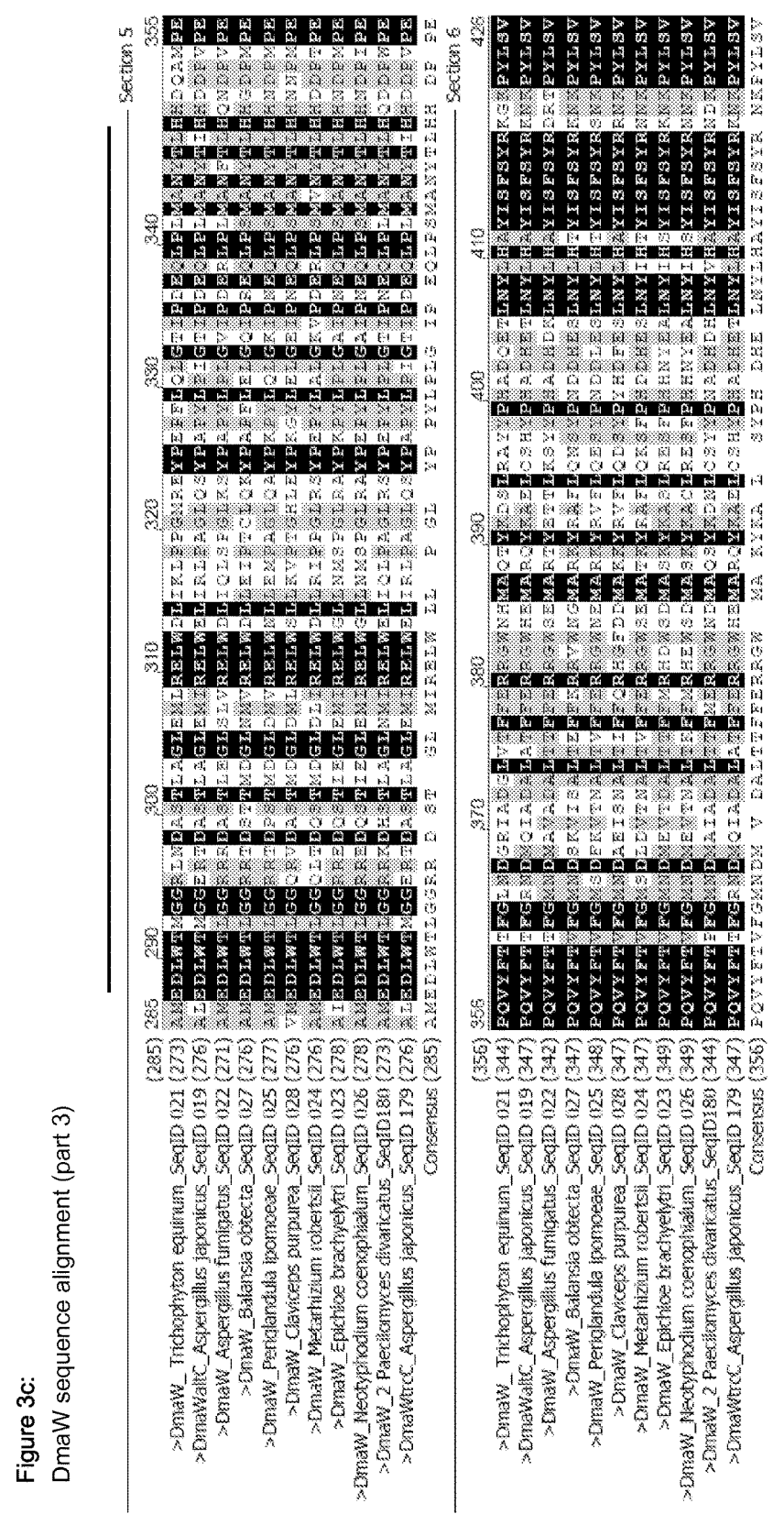
Figure 3D:
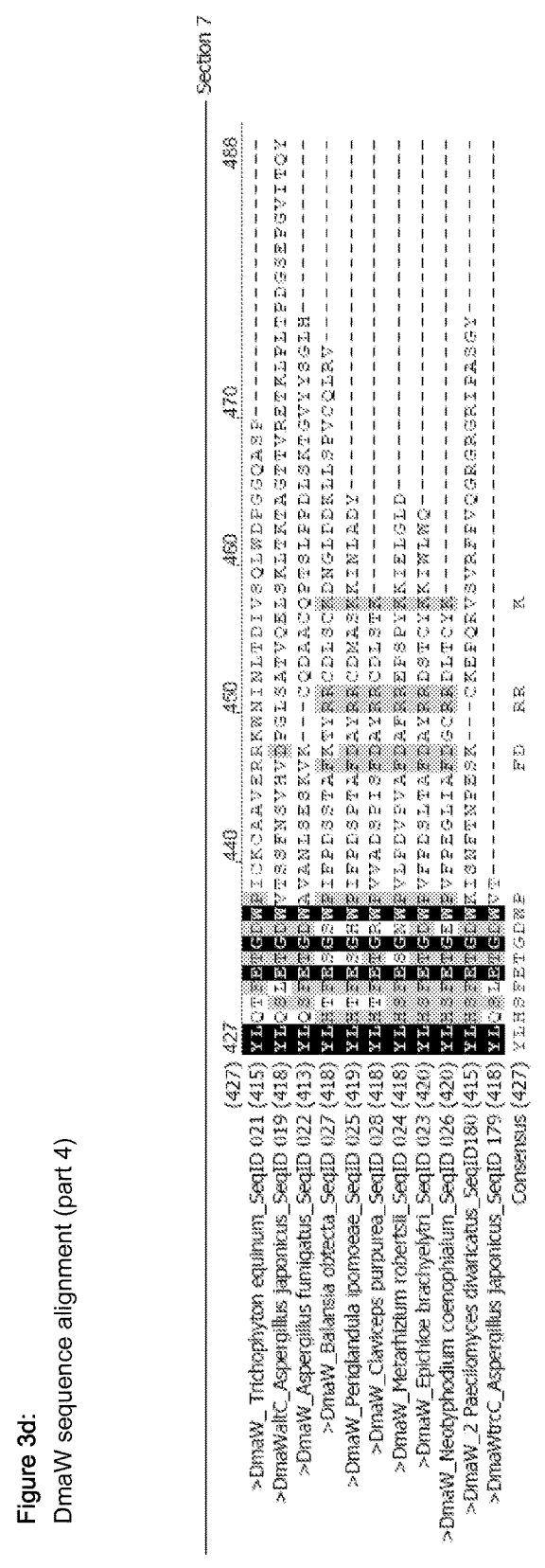

FIGS. 3a to 3d represent consecutive parts of an amino acid sequence alignment of several homolog polypeptides to the *Aspergillus japonicus* polypeptide having DmaW activity. The amino acids are represented according to the standard single letter amino acid code. The names of the different sequences comprise the names of the organisms from which these homolog polypeptides can be obtained, as well as the SEQ ID NOs under which these sequences are listed in the sequence listing. The amino acid sequence alignment depicts also conserved, less conserved and even lesser conserved amino acids in this group of sequences, wherein black shaded amino acid positions represent strong conservation, i.e. being 100% conserved, grey shaded amino acid positions represent less conservation and amino acids having a white background represent even less conserved amino acid positions. Strokes in the amino acid sequence in the alignment represent amino acid positions, which are not comprised in a particular sequence. Black bars above or under a group of amino acid positions depict regions of strong sequence conservation, which represent conserved sequence motifs. The alignment comprises also a consensus sequence for this group of genes (SEQ ID NO: 190), to identify amino acids which are highly conserved at the respective amino acid position. The information about conserved and less conserved amino acids given by this amino acid sequence alignment can be used to determine if amino acid sequences not comprised by the amino acid sequence alignment will be a true homolog of the *Aspergillus japonicus* polypeptide. Amino acids sequences of potential homologs or of naturally occurring or artificially produced mutants will most likely have DmaW activity the more conserved amino acid positions will be comprised by the amino acid sequence in question.

FIGS. 4a to 4c represent consecutive parts of an amino acid sequence alignment of several homolog polypeptides to the *Aspergillus japonicus* polypeptide having EasF activity. The sequence names and symbols, e.g. black or grey shading or the consensus sequence (SEQ ID NO: 154), have the same meaning as explained for the sequence names and symbols used in FIGS. 3a to 3d.

Figure 5B:
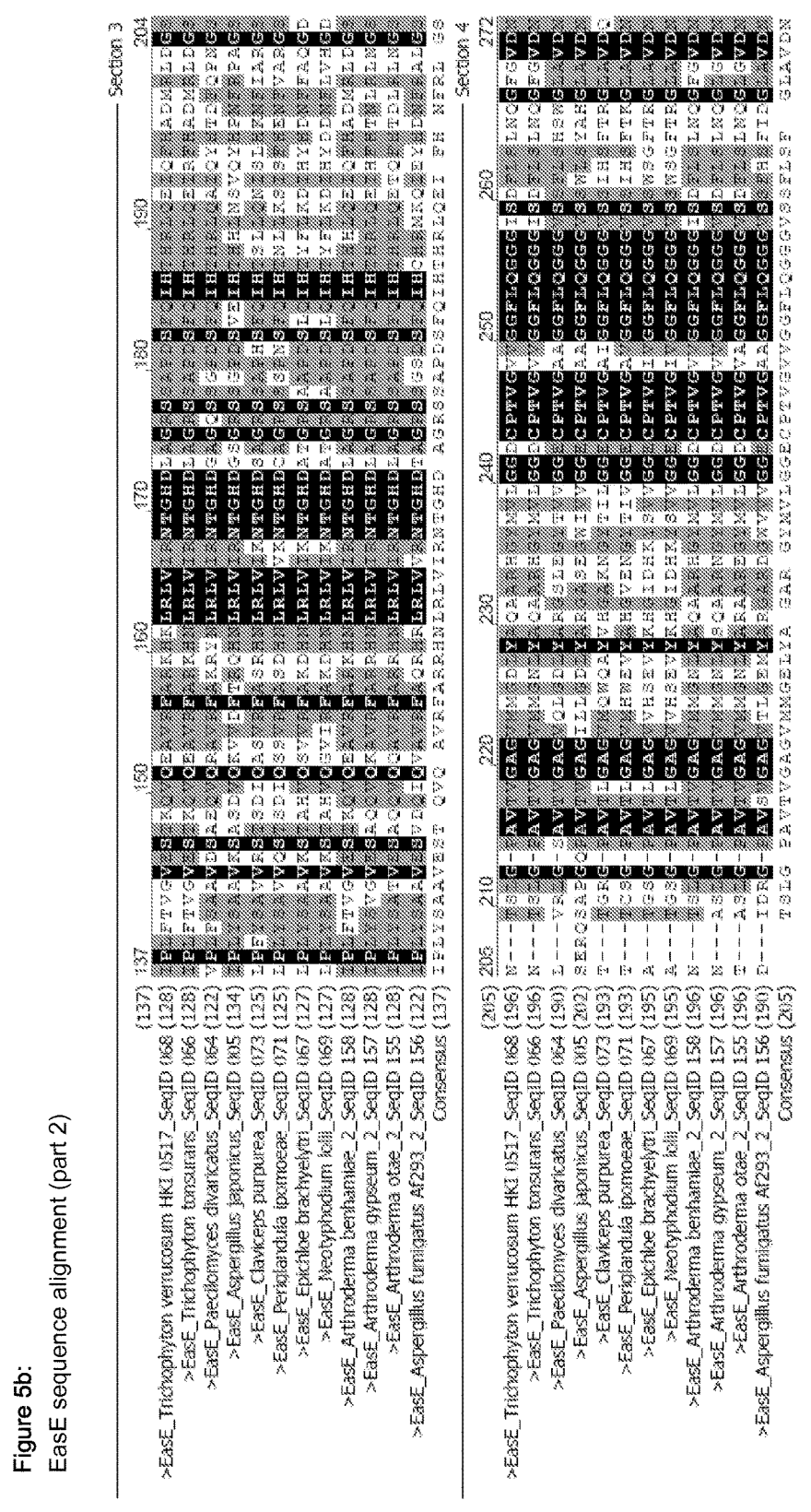
Figure 5E:
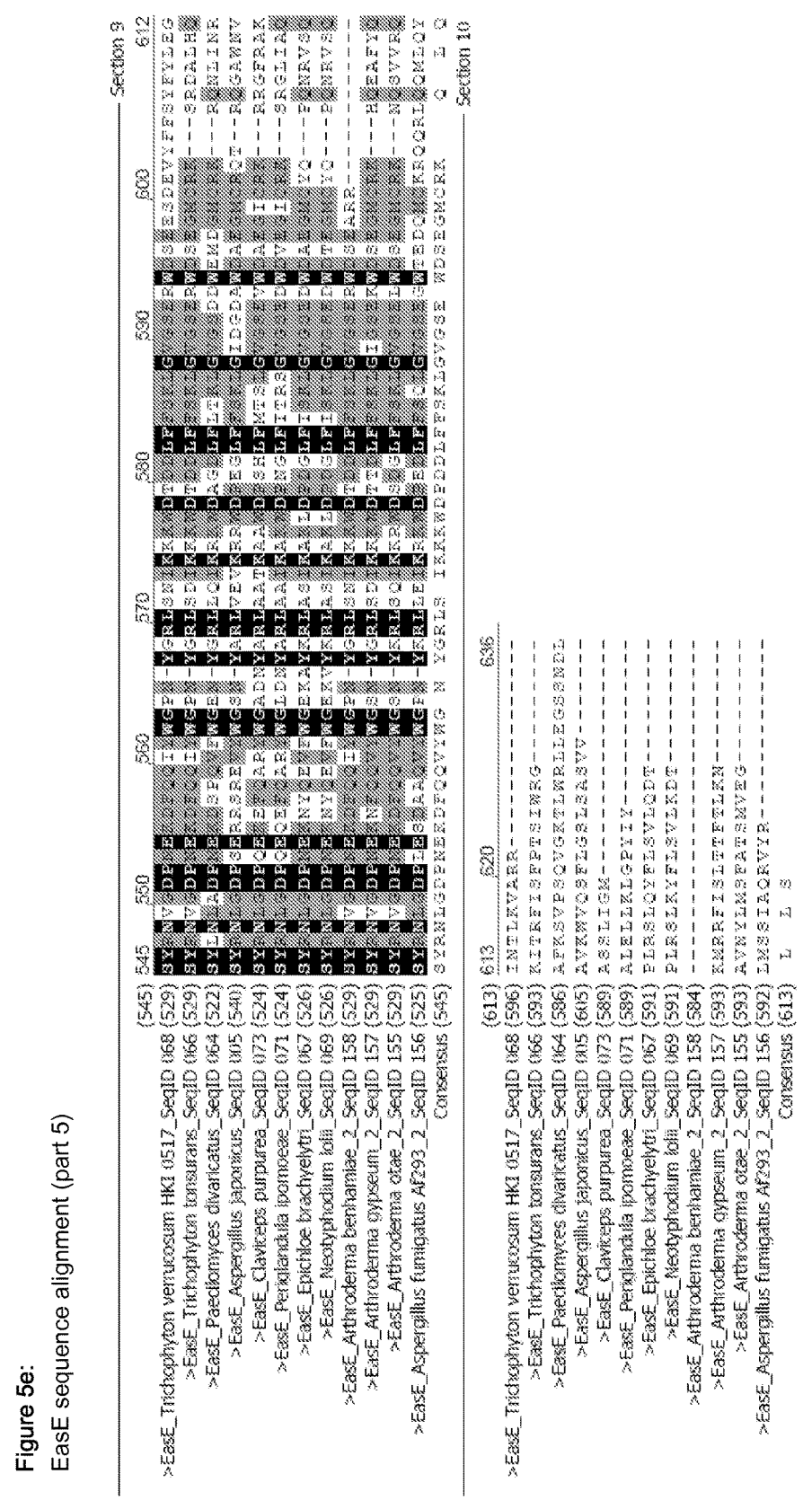

FIGS. 5a to 5e represent consecutive parts of an amino acid sequence alignment of several homolog polypeptides to the *Aspergillus japonicus* polypeptide having EasE activity.

The sequence names and symbols, e.g. black or grey shading or the consensus sequence (SEQ ID NO: 185) comprising a core consensus as depicted in (SEQ ID NO: 191), have the same meaning as explained for the sequence names and symbols used in FIGS. 3a to 3d.

Figure 6B:
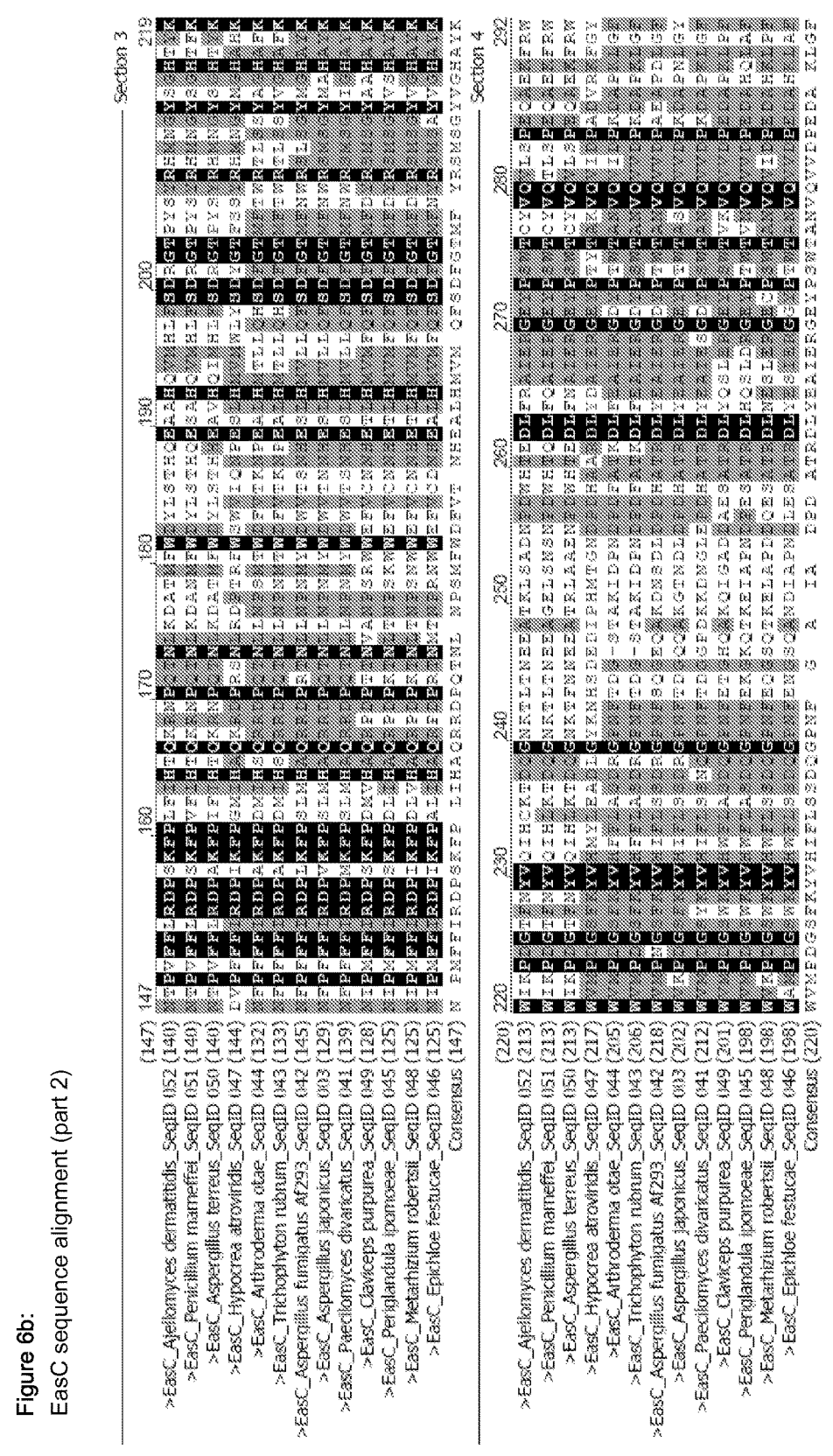
Figure 6D:
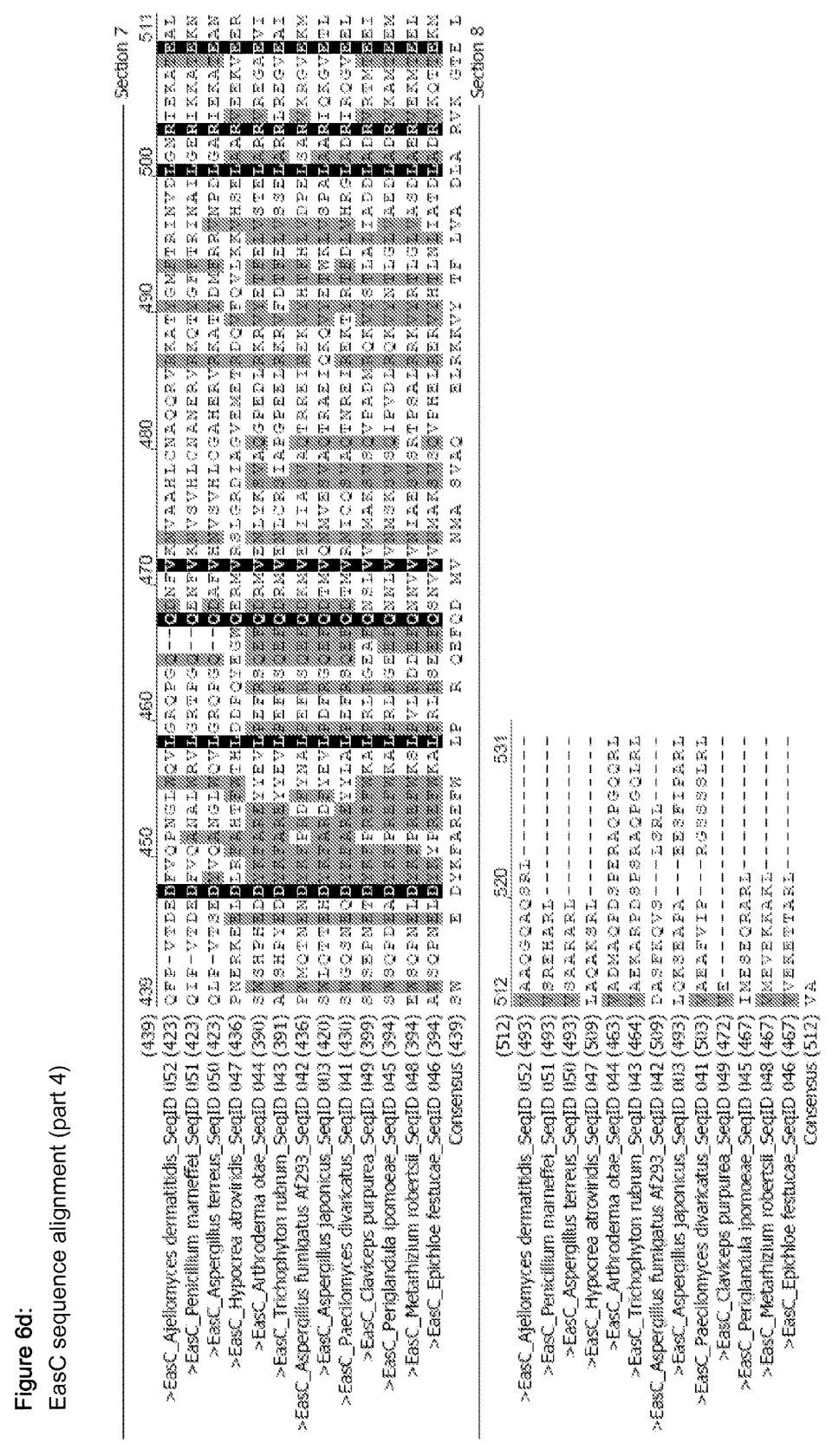

FIGS. 6a to 6d represent consecutive parts of an amino acid sequence alignment of several homolog polypeptides to the *Aspergillus japonicus* polypeptide having EasC activity. The sequence names and symbols, e.g. black or grey shading or the consensus sequence (SEQ ID NO: 151), have the same meaning as explained for the sequence names and symbols used in FIGS. 3a to 3d.

Figure 7A:
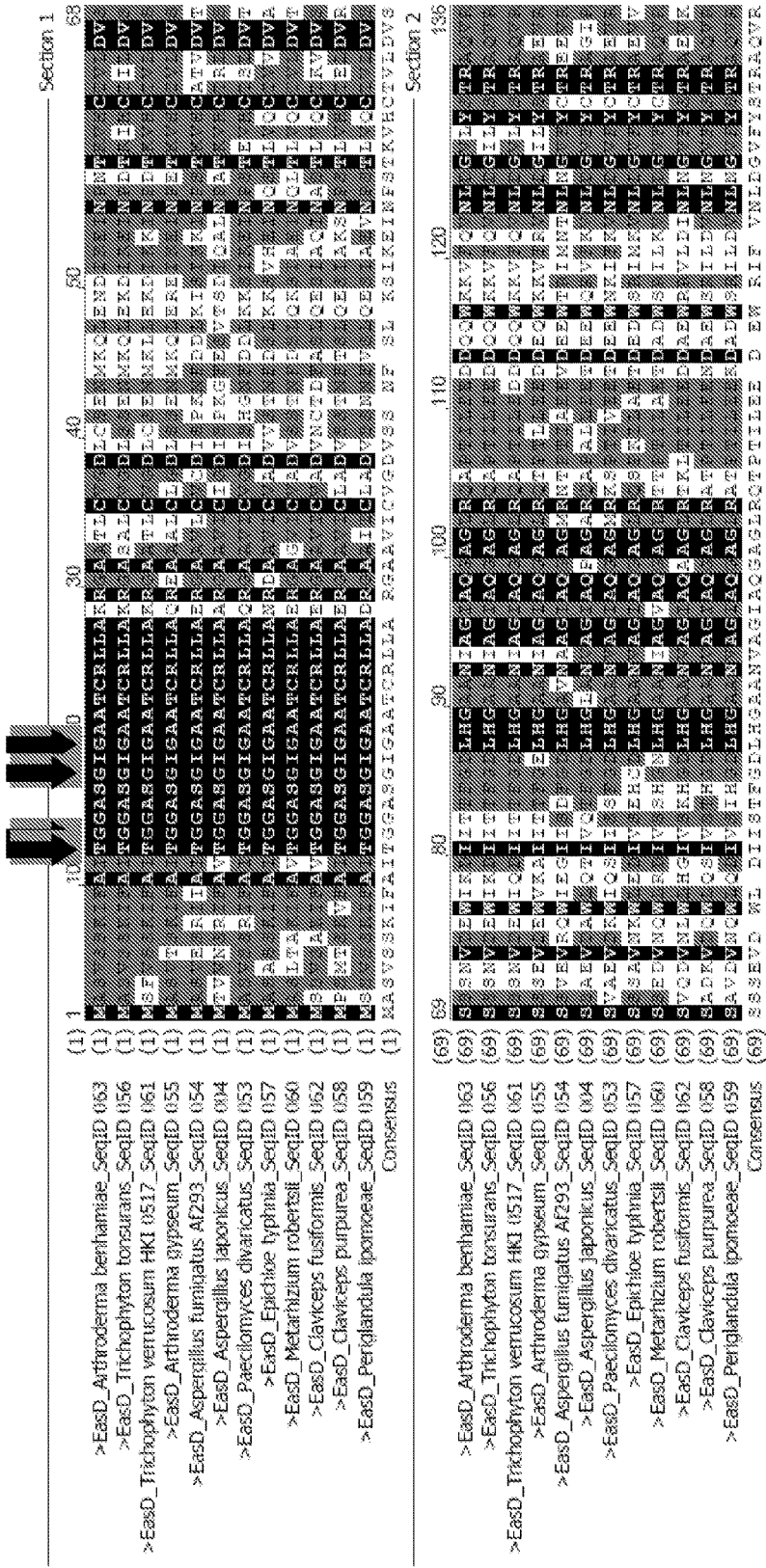
Figure 7B:
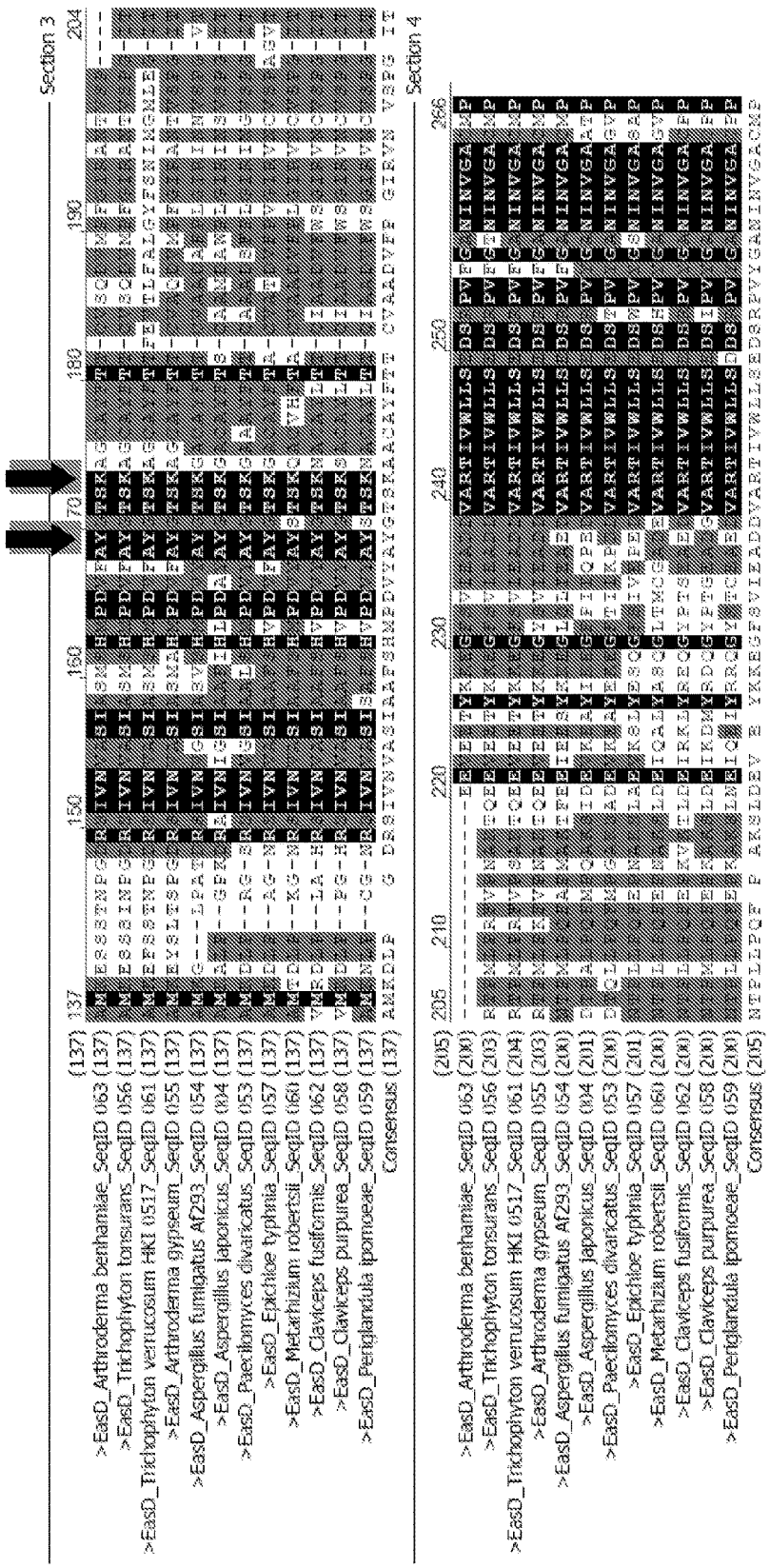

FIGS. 7a to 7b represent consecutive parts of an amino acid sequence alignment of several homolog polypeptides to the *Aspergillus japonicus* polypeptide having EasD activity. The sequence names and symbols, e.g. black or grey shading or the consensus sequence (SEQ ID NO: 152), have the same meaning as explained for the sequence names and symbols used in FIGS. 3a to 3d. The four black arrows in FIG. 7a and the two black arrows in FIG. 7b point to conserved amino acids of the cofactor-binding motif TGxxxGxG (SEQ ID NO: 188) and the conserved amino acids of the active site motif YxxxK (SEQ ID NO: 198) of proteins having EasD activity (Kavanagh 2008, Cell Mol Life Sci 65:3895-3906).

Figure 8:
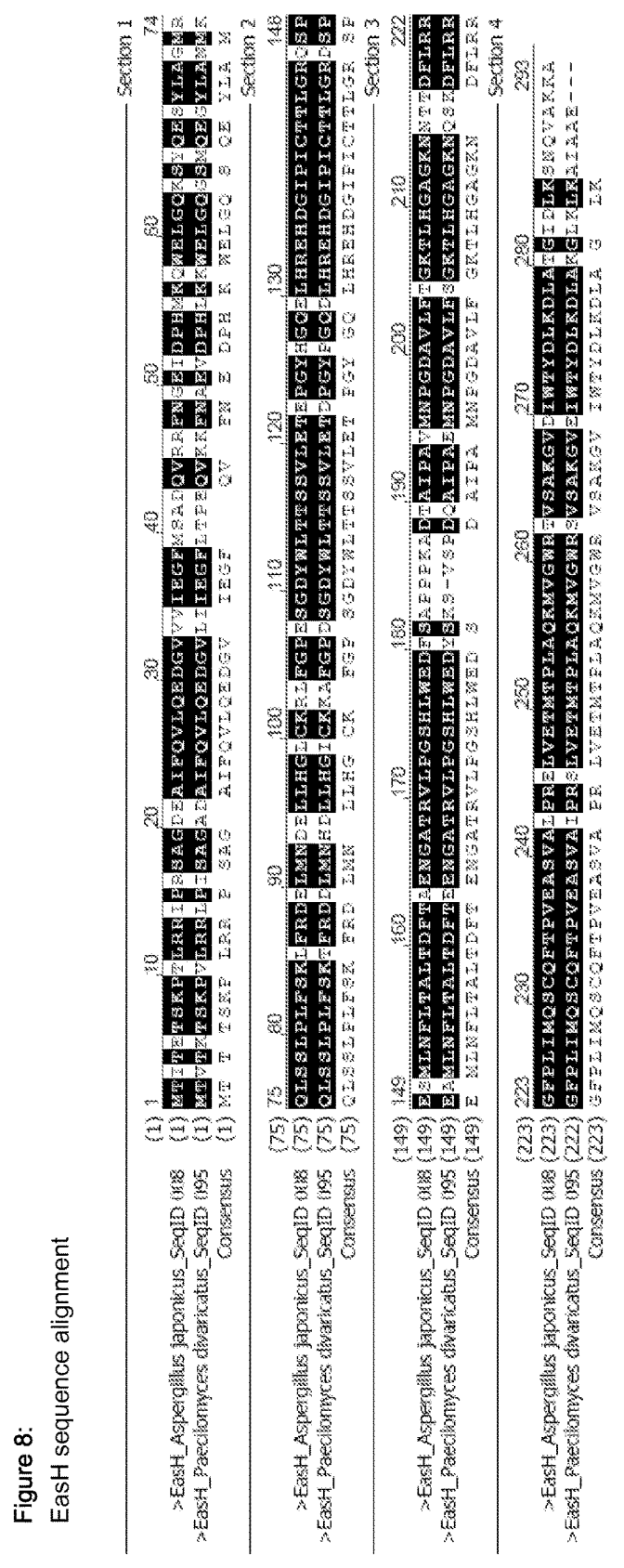

FIG. 8 represents an amino acid sequence alignment of a homolog polypeptide to the *Aspergillus japonicus* polypeptide having EasH activity. The sequence names and symbols, e.g. black or grey shading or the consensus sequence (SEQ ID NO: 183), have the same meaning as explained for the sequence names and symbols used in FIGS. 3a to 3d.

Figure 9A:
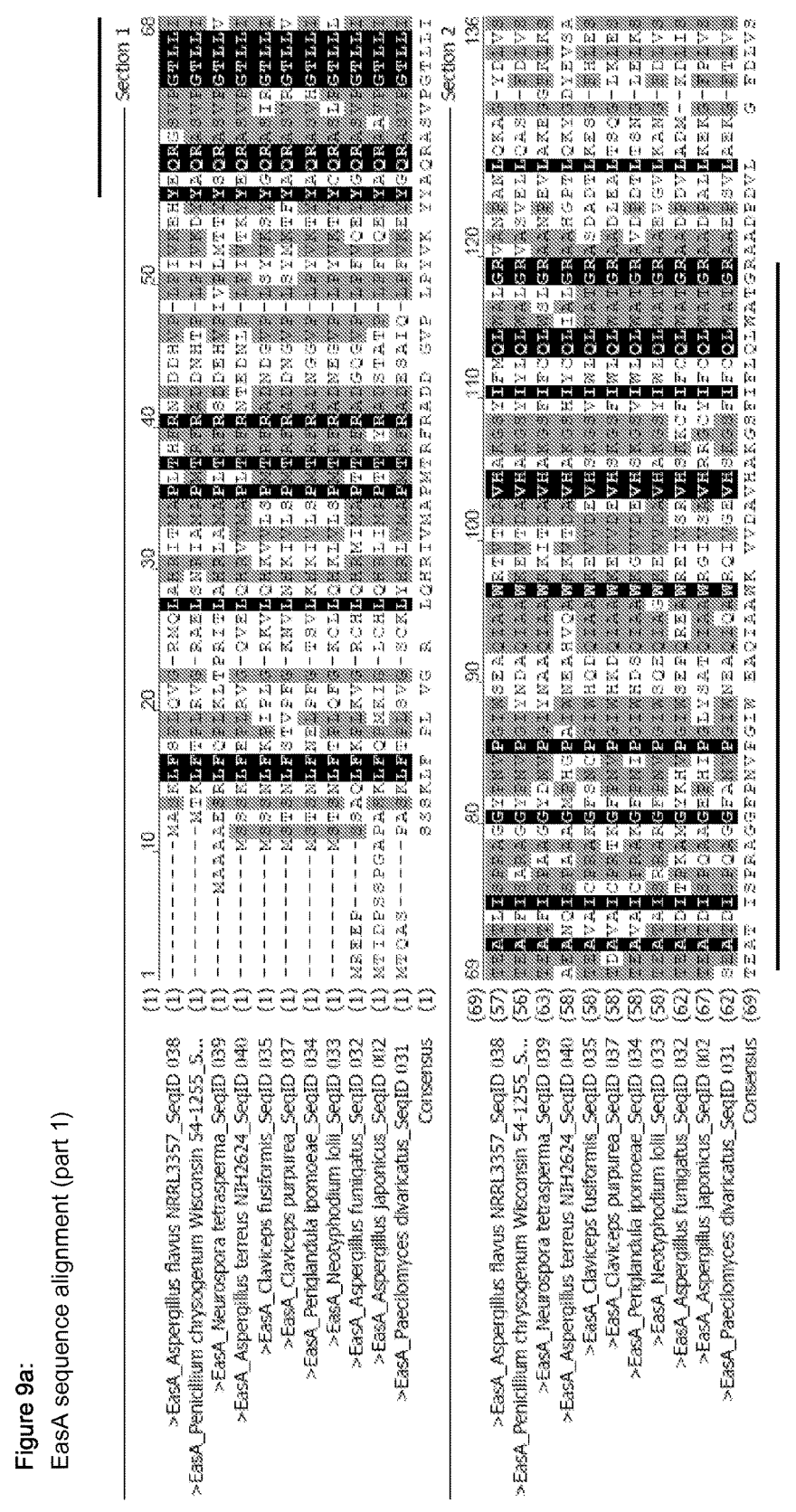
Figure 9B:
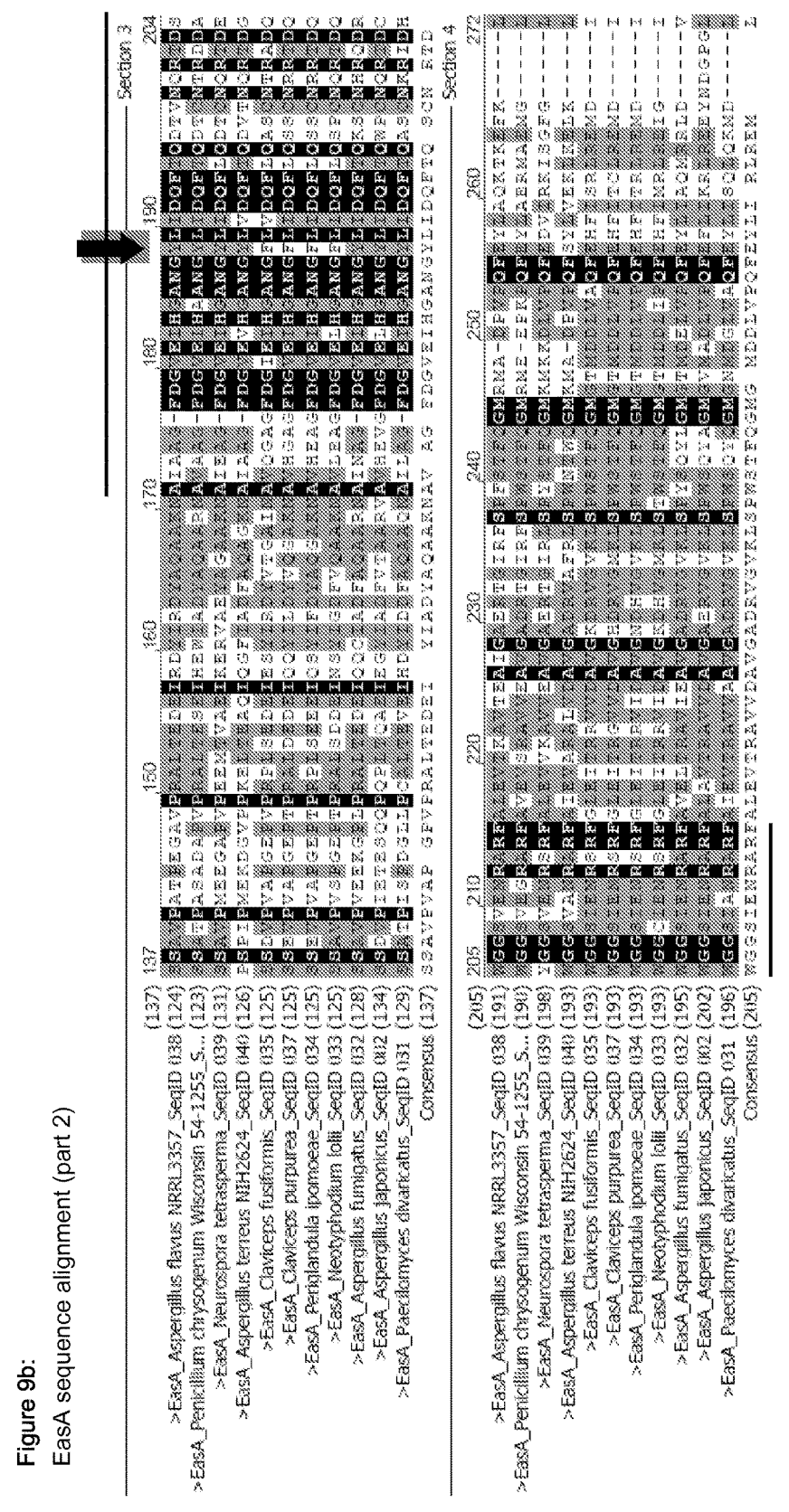
Figure 9C:
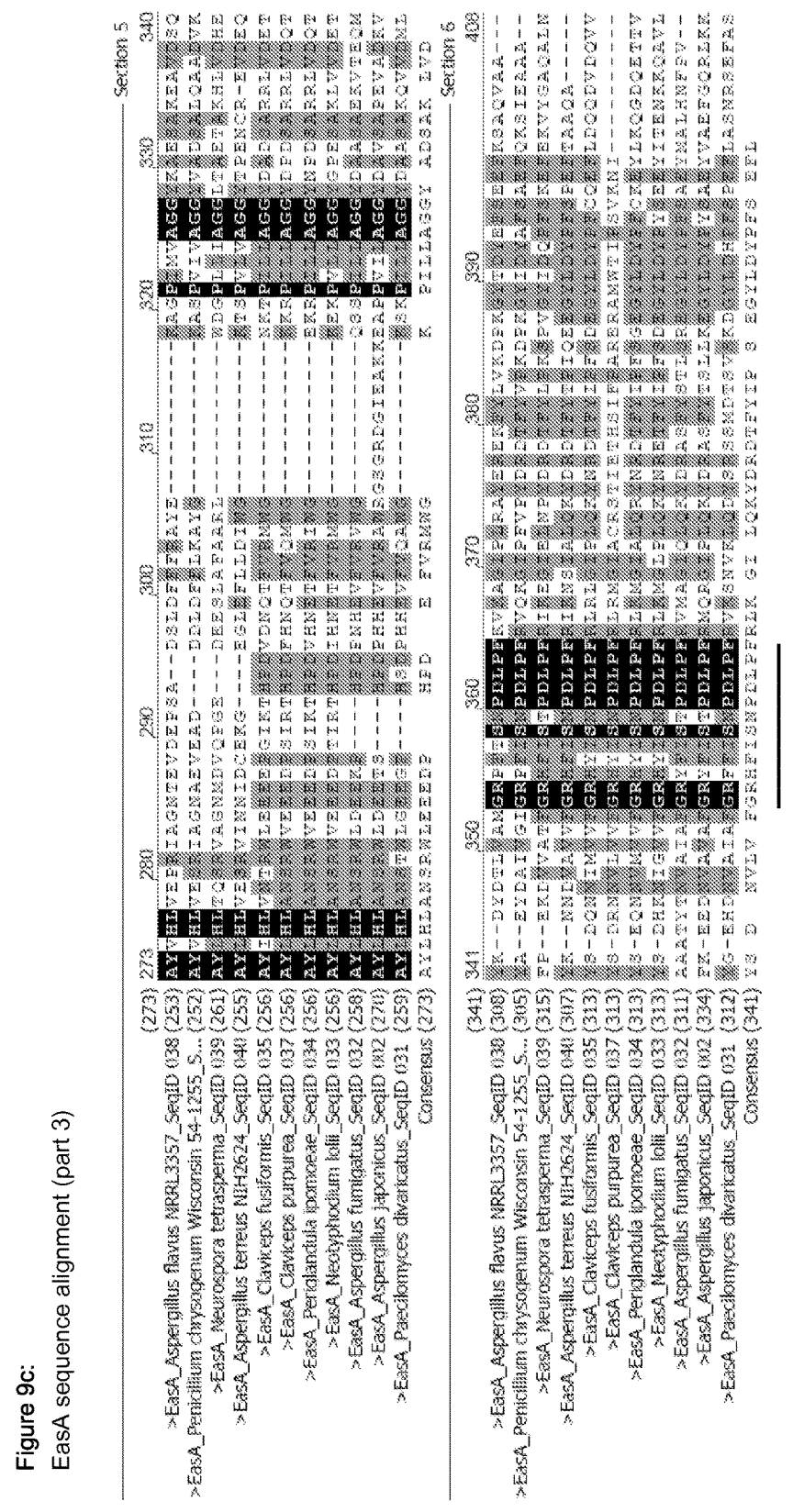

FIGS. 9a to 9d represent consecutive parts of an amino acid sequence alignment of several homolog polypeptides to the *Aspergillus japonicus* polypeptide having EasA activity. The sequence names and symbols, e.g. black or grey shading, black bars or the consensus sequence (SEQ ID NO: 184), have the same meaning as explained for the sequence names and symbols used in FIGS. 3a to 3d. FIG. 9b comprises an additional black arrow pointing to an amino acid position comprising either Y, representing the amino acid Tyrosine, or F, representing the amino acid Phenylalanine. The amino acid sequences having Y at this position represent polypeptides having as EasA reductase activity, while amino acid sequences having F at its position represent polypeptides having an EasA isomerase activity. These activities are sometimes also described as EasA (Tyr176) and EasA (Phe176), for EasA reductase and EasA isomerase activity, respectively, wherein the number 176 refers to the corresponding amino acid position, having either an Y or F, in the polypeptide of *Aspergillus fumigatus*, having either EasA reductase or EasA isomerase activity, respectively (Cheng et al; 2010, J. AM. CHEM. SOC, 132: p 12835-12837)

Figure 10A:
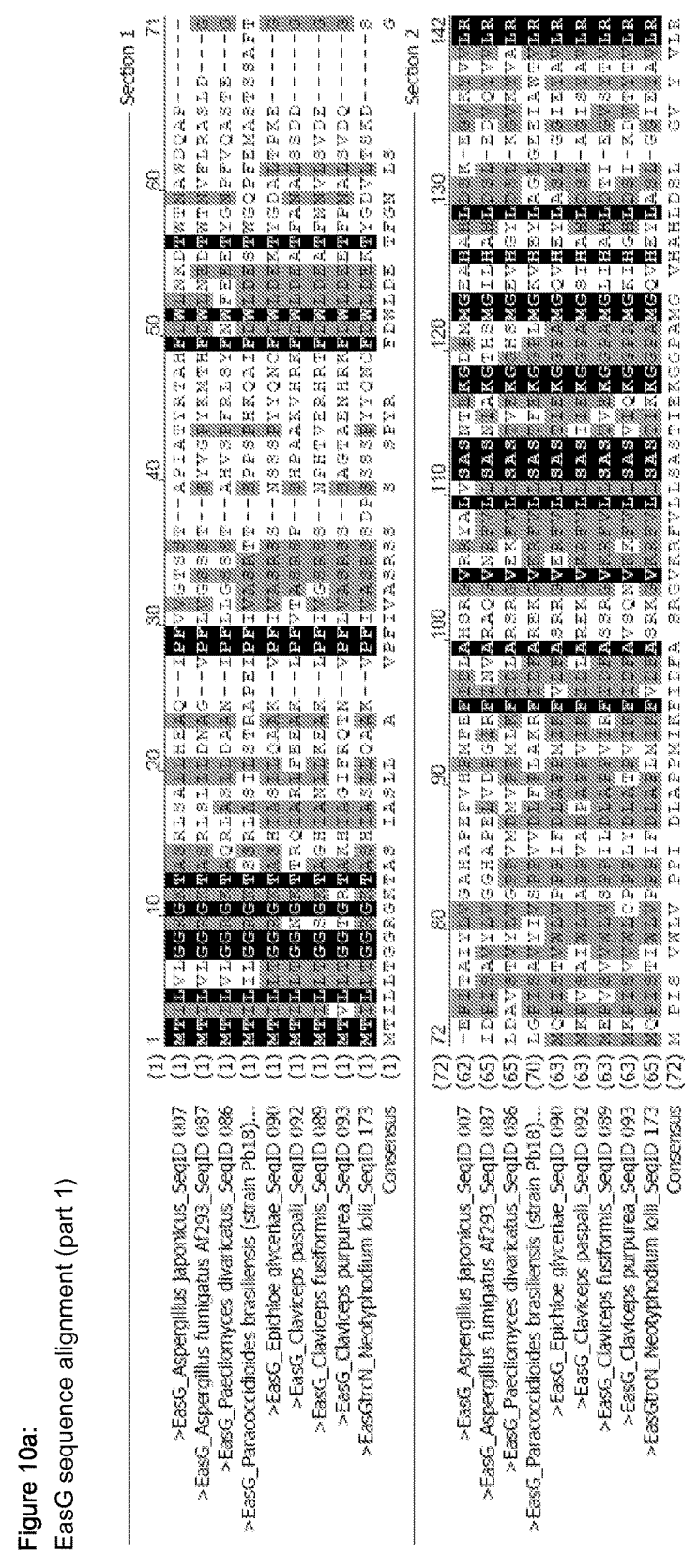
Figure 10B:
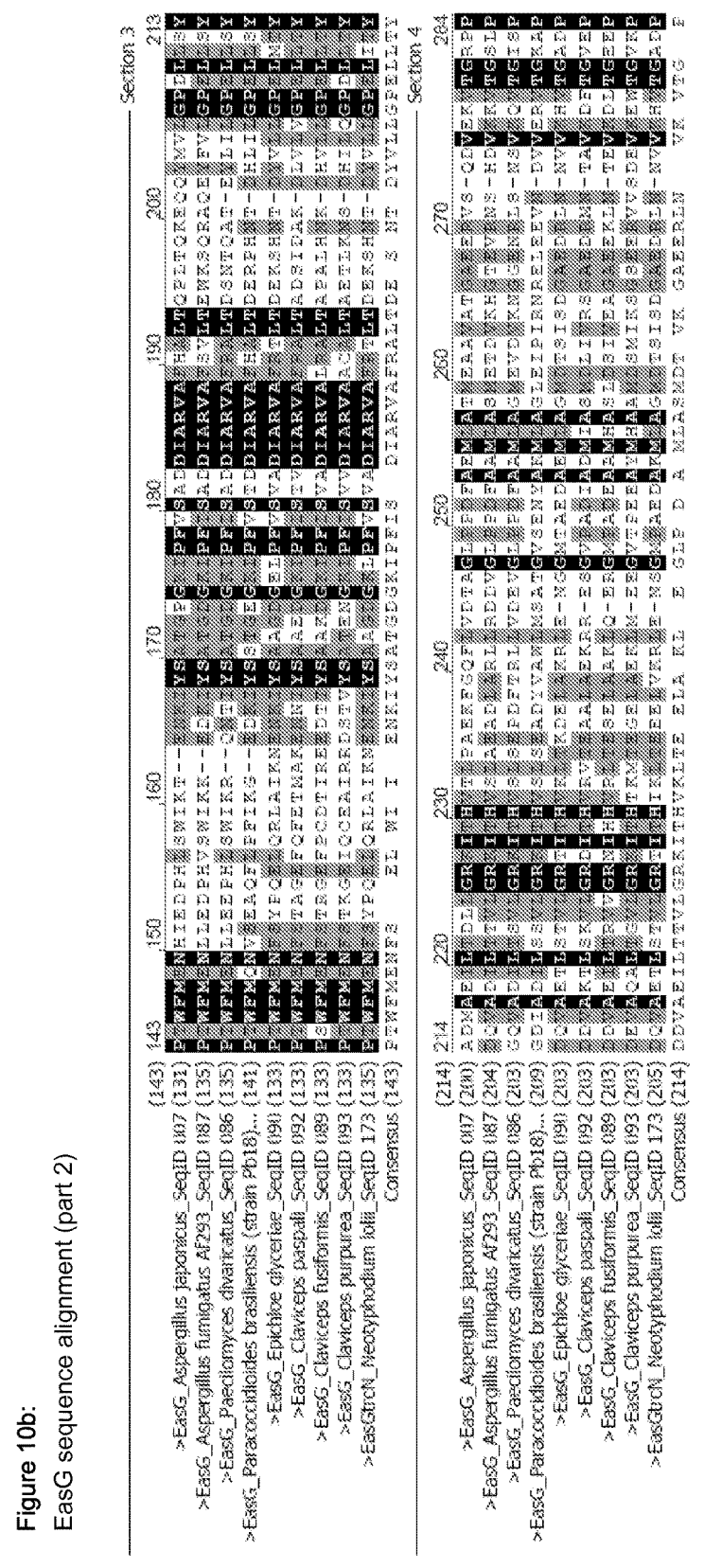
Figure 10C:
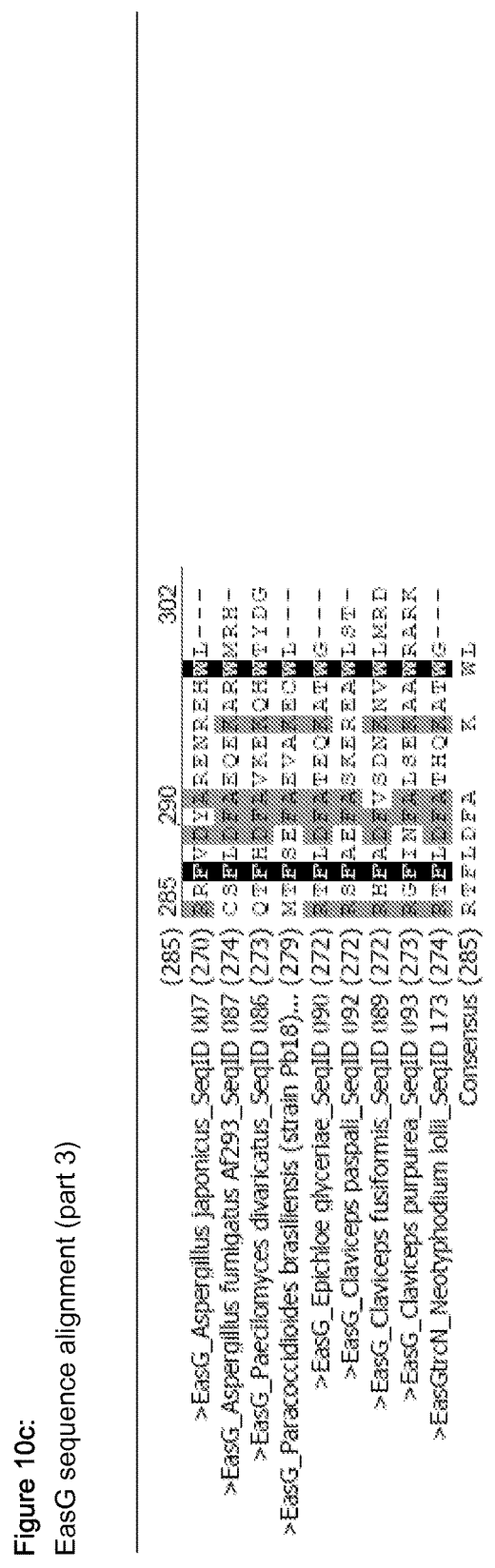

FIGS. 10a to 10c represent consecutive parts of an amino acid sequence alignment of several homolog polypeptides to the *Aspergillus japonicus* polypeptide having EasG activity. The sequence names and symbols, e.g. black or grey shading or the consensus sequence (SEQ ID NO: 183), have the same meaning as explained for the sequence names and symbols used in FIGS. 3a to 3d.

Figure 11:
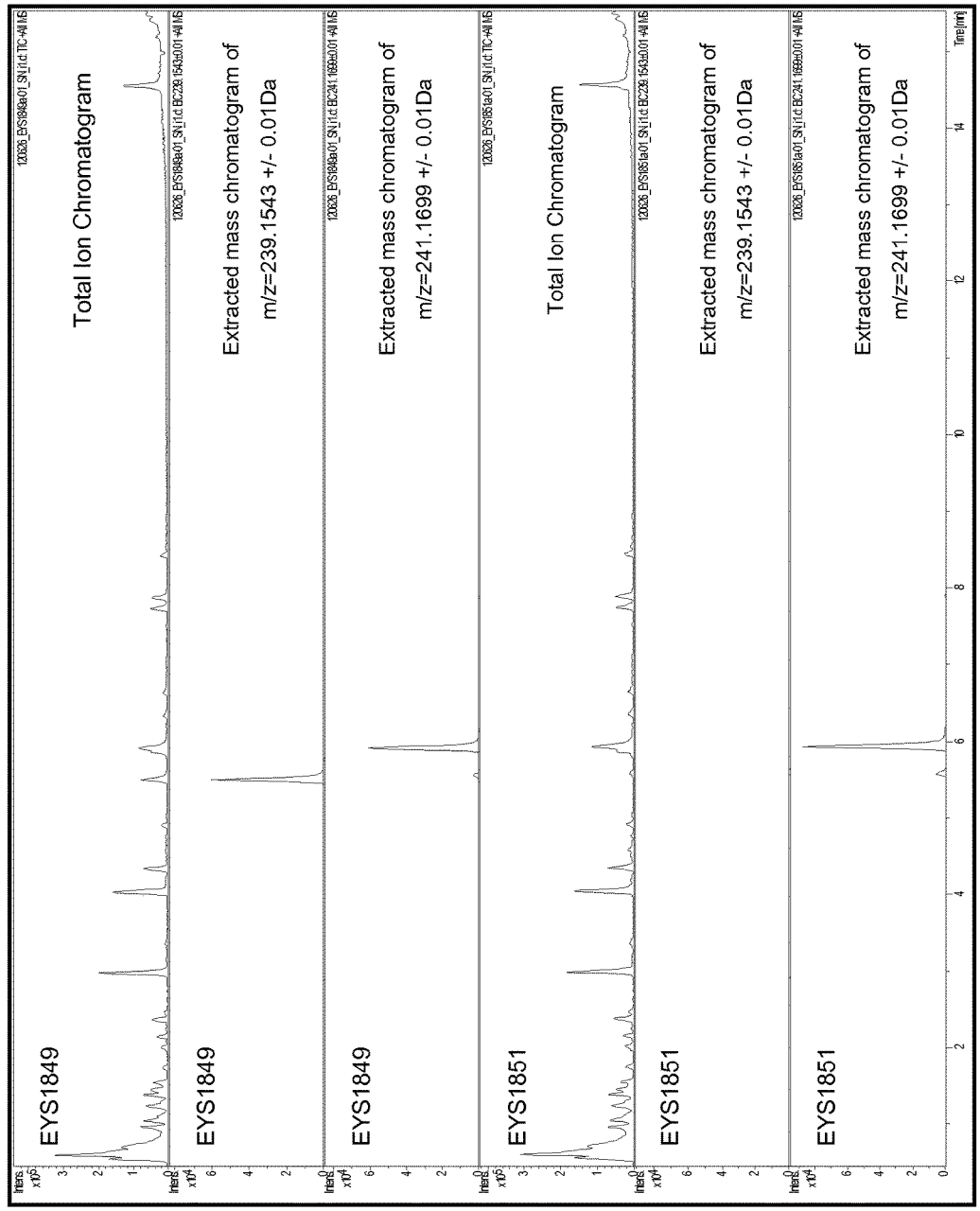

FIG. 11 shows Chromatograms of supernatants of yeast strains from top to bottom: EYS1849 total ion chromatogram; EYS1849 extracted ion chromatogram of m/z=239.1543+/−0.01 Da; EYS1849 extracted ion chromatogram of m/z=241.1699+/−0.01 Da; EYS1851 total ion chromatogram; EYS1851 extracted ion chromatogram of m/z=239.1543+/−0.01 Da; EYS1851 extracted ion chromatogram of m/z=241.1699+/−0.01 Da.

Figure 12:
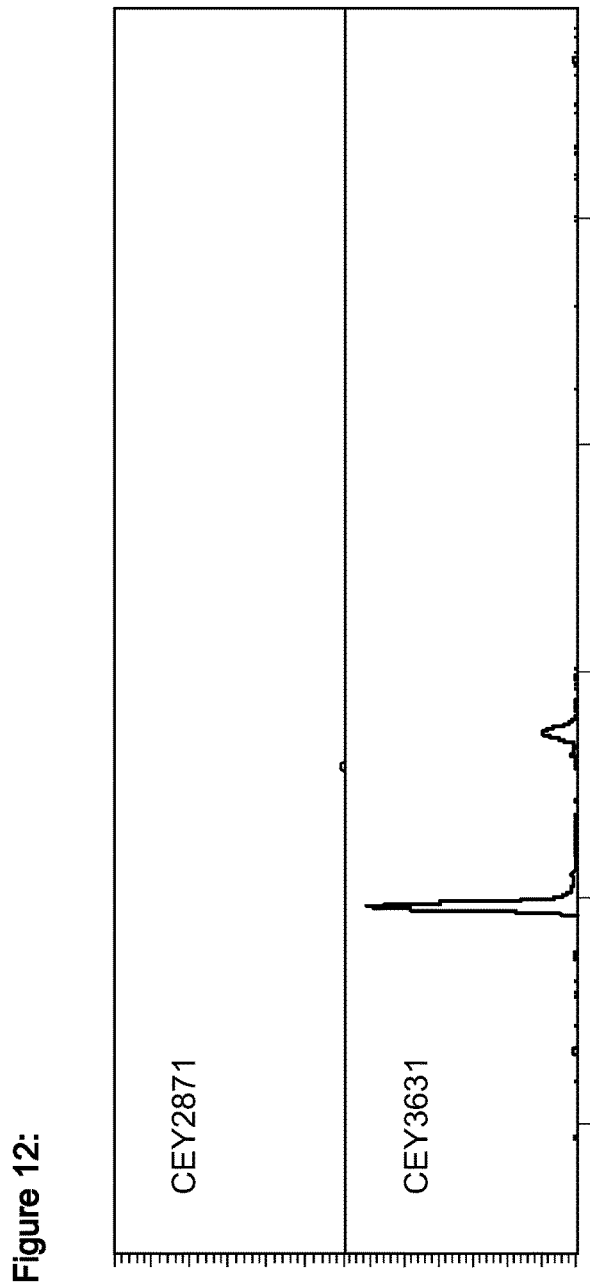

FIG. 12 shows the analysis of Supernatants of strains CEY2871 and CEY3631 were analyzed by LC-MS. The mass of chanoclavine I (m/z=257.164+/−0.01 Da) was extracted from the TIC (Total Ion Chromatogram), exhibiting a peak at a retention time of 2.0 min.+/−0.1 min in CEY3631 which was absent in CEY2871. The peak was purified and analyzed by NMR.

Figure 13:
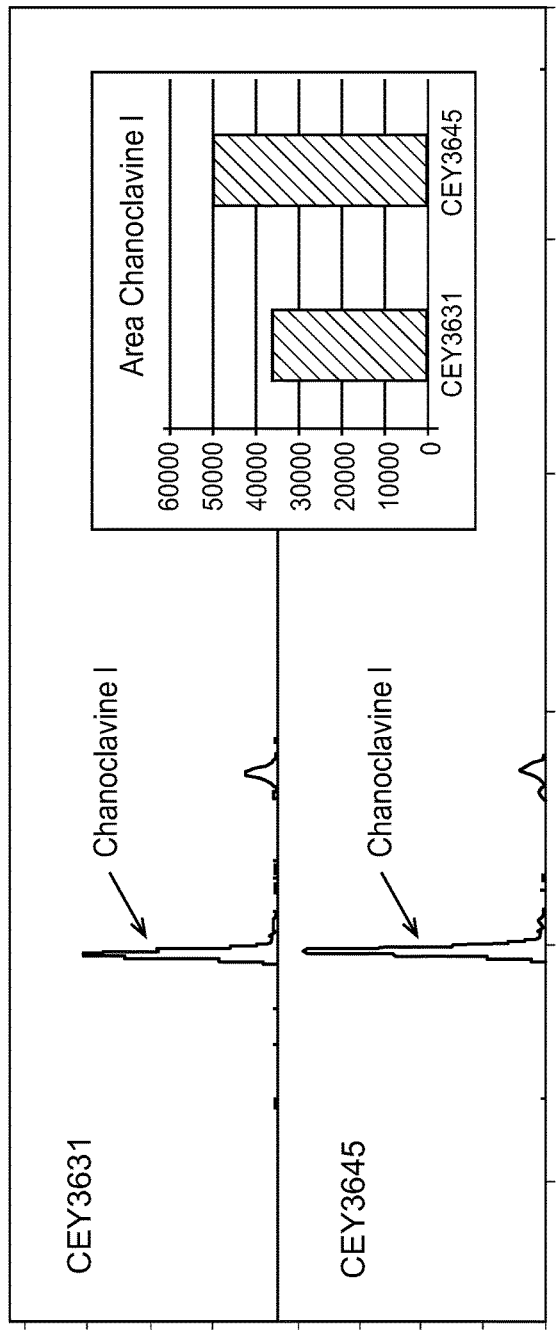

FIG. 13 shows the analysis of Supernatants of strains CEY3631 and CEY3645 were analysed by LC-MS. The mass of chanoclavine I (m/z=257.164+/−0.01 Da) was extracted from the TIC (Total Ion Chromatogram) exhibiting a peak at retention time 2.0+/−0.1 min in both CEY3631 and CEY3645. The areas under the peaks were integrated (insert) revealing an increase of chanoclavine I in CEY3645 compared to EY3631.

Figure 14:
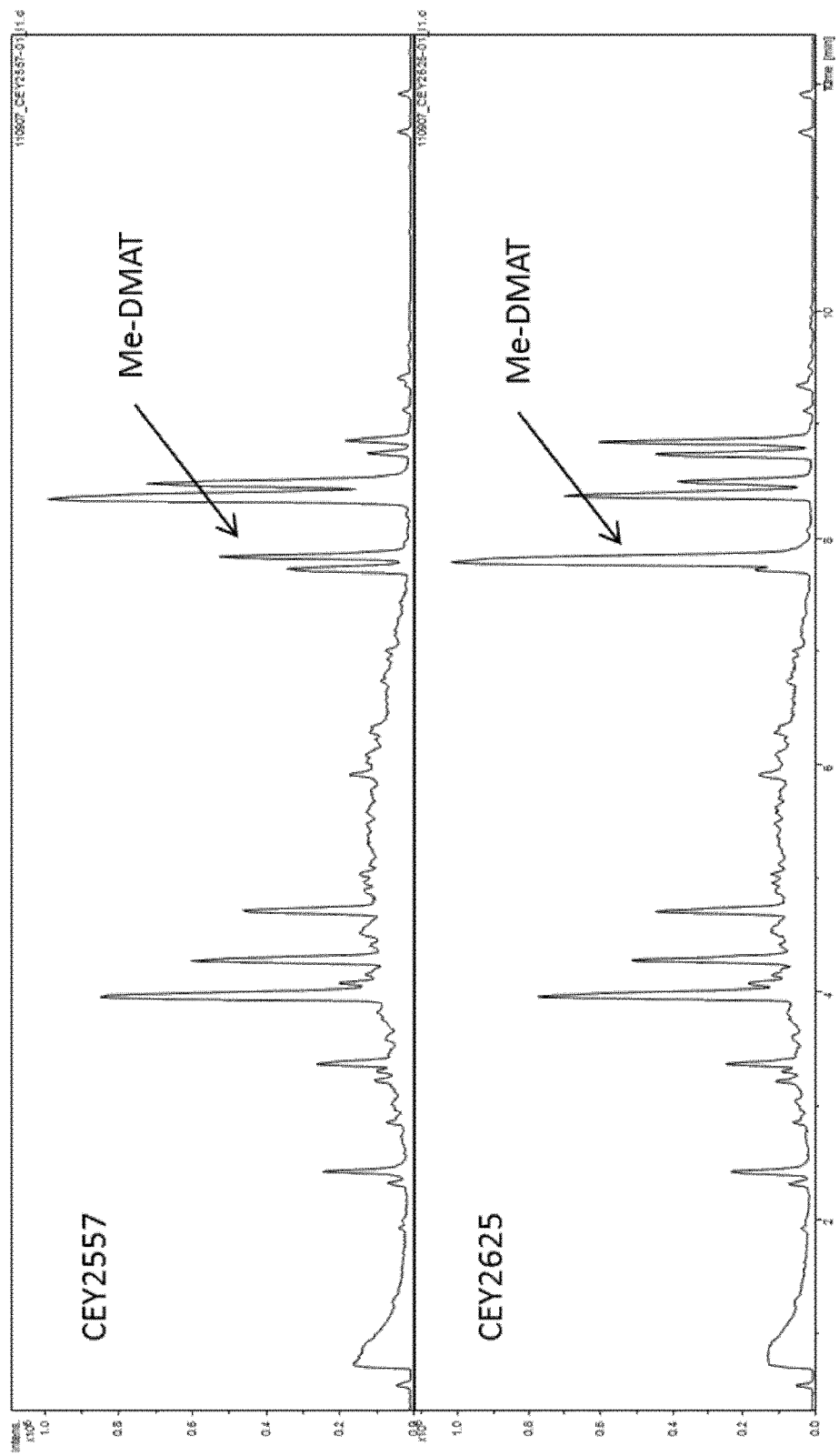

FIG. 14 Strains CEY2557 and CEY2625 were analyzed by LC-MS. A peak was seen in both strains at a retention time of 7.8 min.+/−0.2 min. which had the predicted mass (m/z=287.175+/−0.01 Da) of Me-DMAT. The identity was confirmed by NMR. The areas under the peaks were integrated revealing a more than two fold increase of Me-DMAT in CEY2625 as compared to CEY2557

Figure 15:
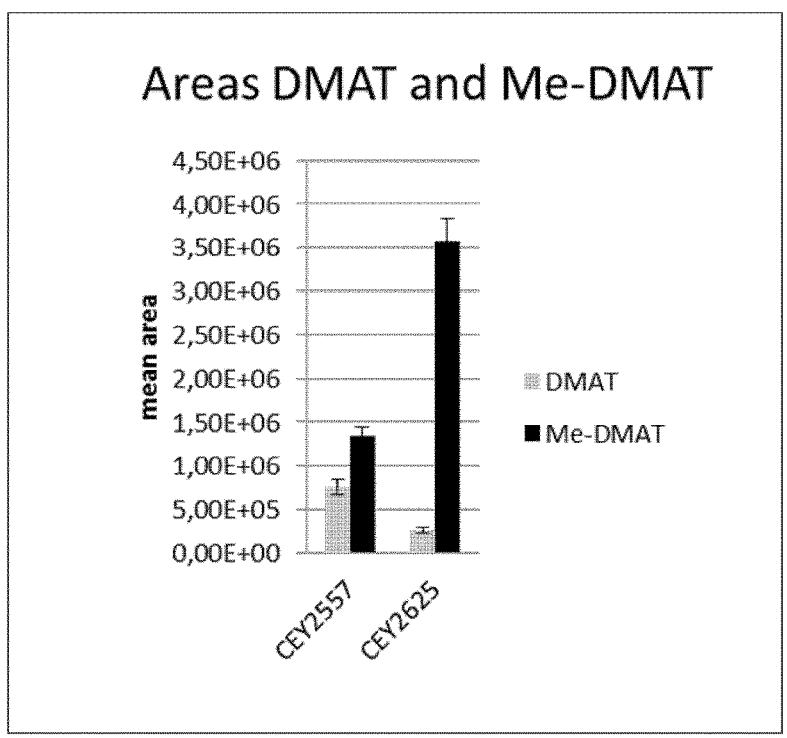

FIG. 15: Strains CEY2557 and CEY2625 were analysed by LC-MS. (See FIG. 6). The areas under the peaks were integrated revealing a more than two fold increase of Me-DMAT in CEY2625 as compared to CEY2557. Areas of DMAT are also shown.

Figure 16:
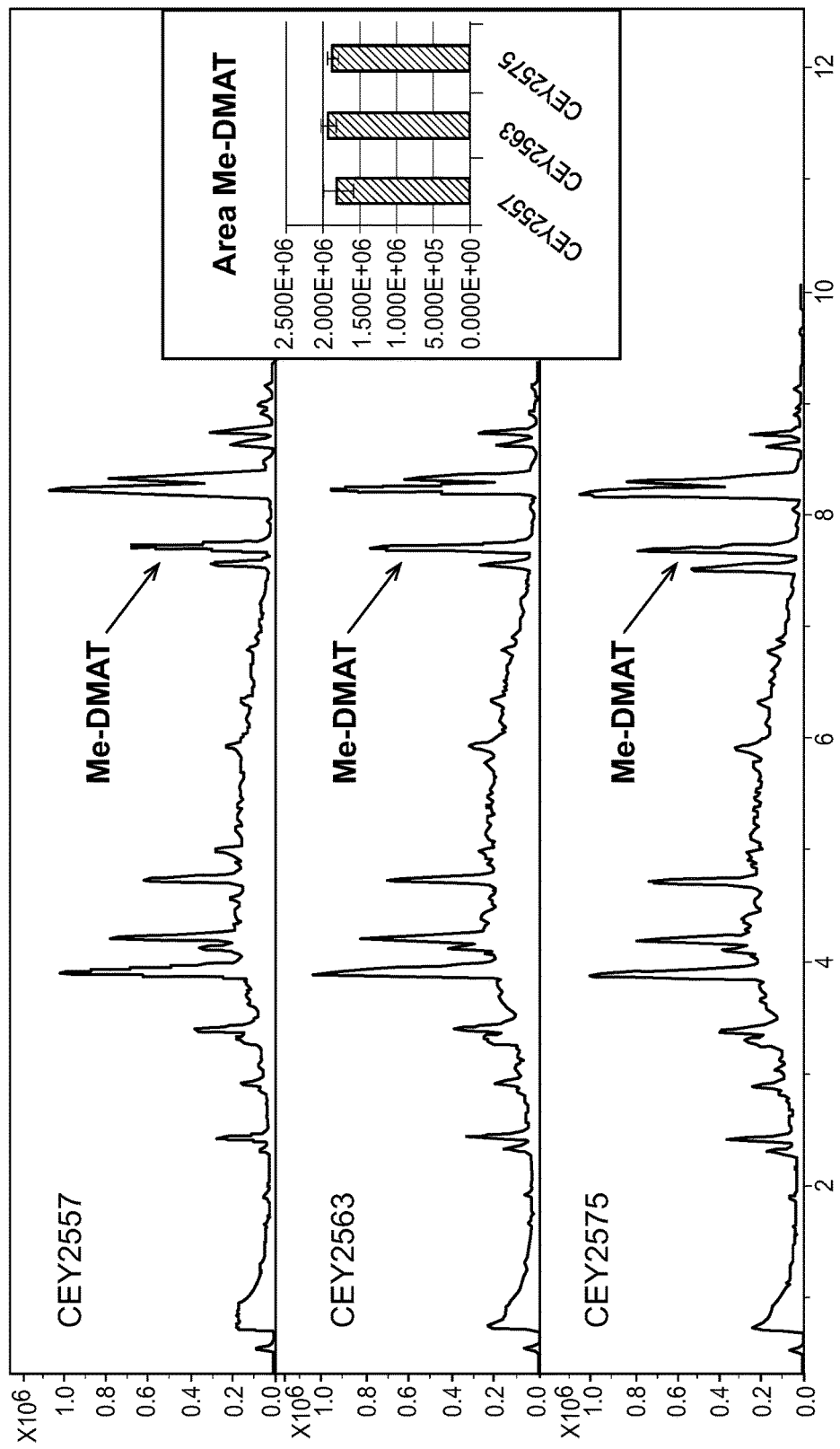

FIG. 16 Strains CEY2557, CEY2563 and CEY2575 were analyzed by LC-MS. In all strains a peak was seen at a retention time of 7.8 min.+/−0.2 min. which had the predicted mass (m/z=287.175+/−0.01 Da) of Me-DMAT. Areas under the peaks were integrated, showing similar levels of compound (insert) in all three strains. The identity of the compound was confirmed by NMR.

Figure 17:
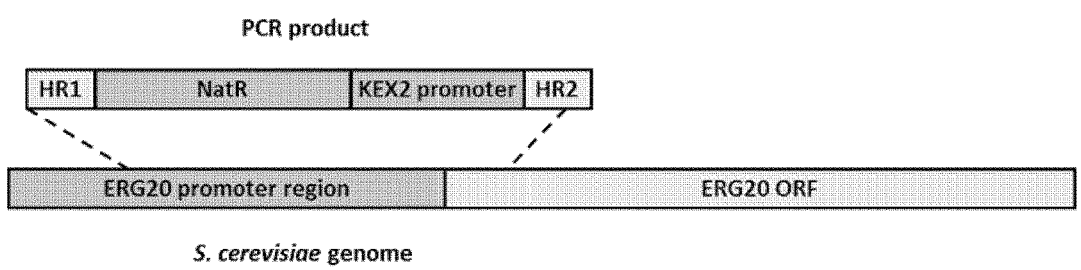
Figure 18:
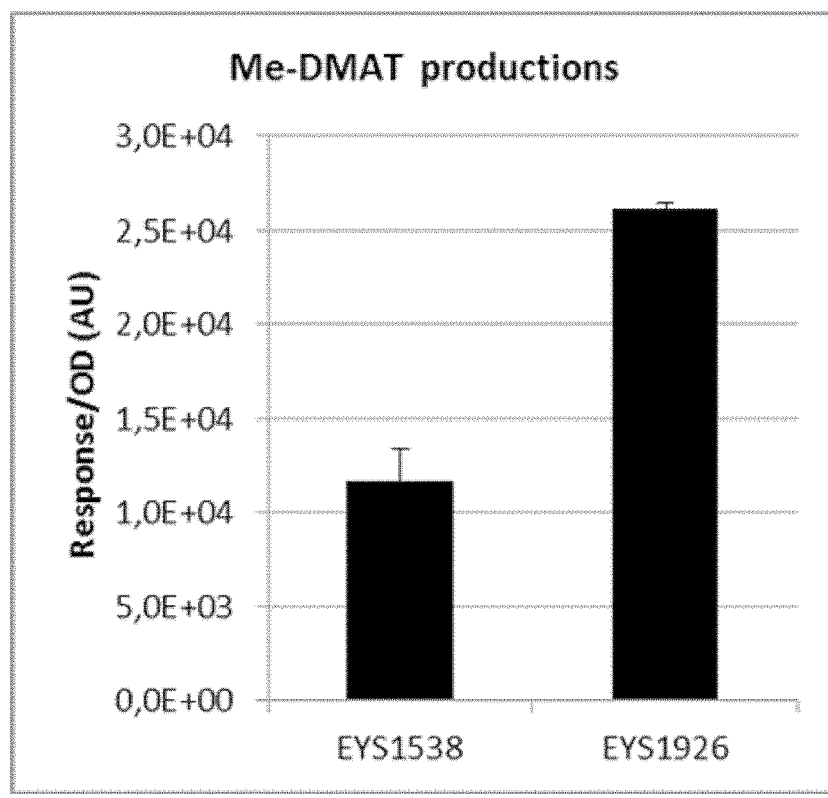

FIG. 17 Outline of the PCR product used for integration into the ERG20 gene, and the target region in the yeast genome. HR1 and HR2 are homologous to the genomic sequence and allows integration, by homologous recombination, of the NatR-ScKex2 promoter construct and thereby disrupting the native ERG20 promoter FIG. 18 Strains EYS1538 and EYS1926 were analysed by LC-MS. The areas under the peaks were integrated revealing a more than two fold increase of Me-DMAT in EYS1926 as compared to EYS1538.

Figure 19:
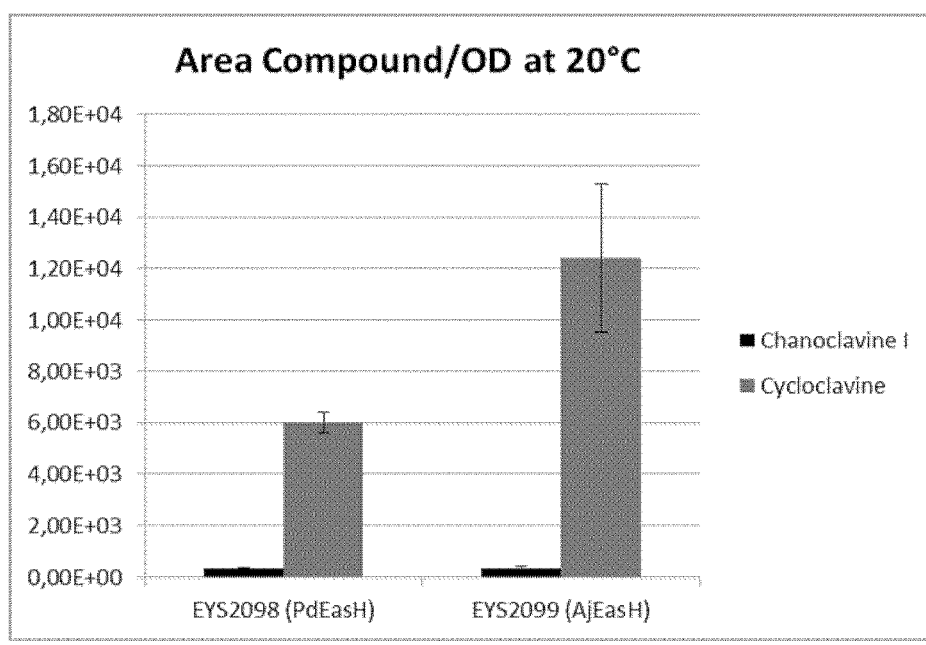

FIG. 19 Analysis of culture supernatants from EYS2098 and EYS2099 showing the relative amounts (area under the curve) of chanoclavine I and cycloclvine, produced by these strains.

Figure 20A:
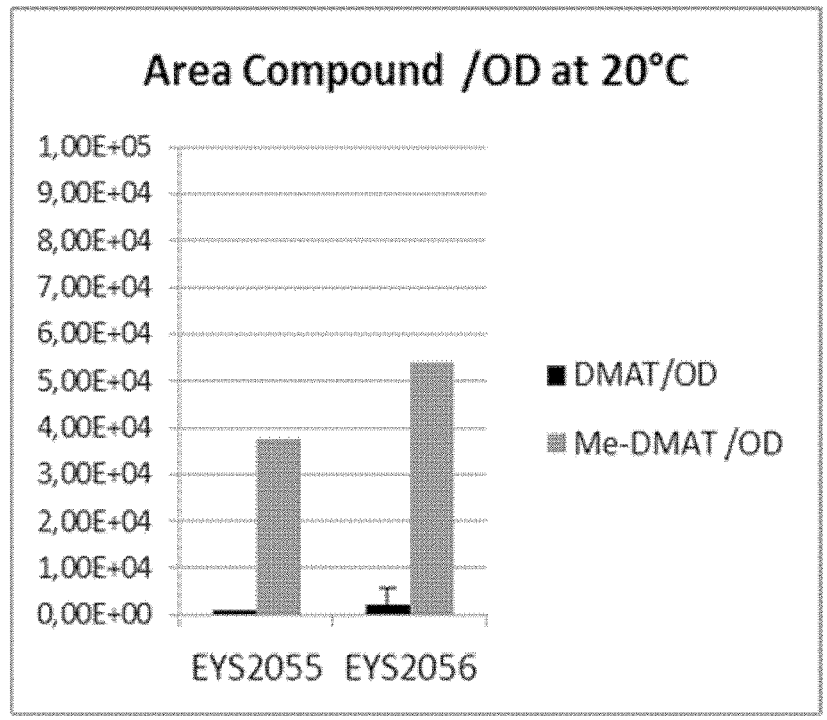
Figure 20B:
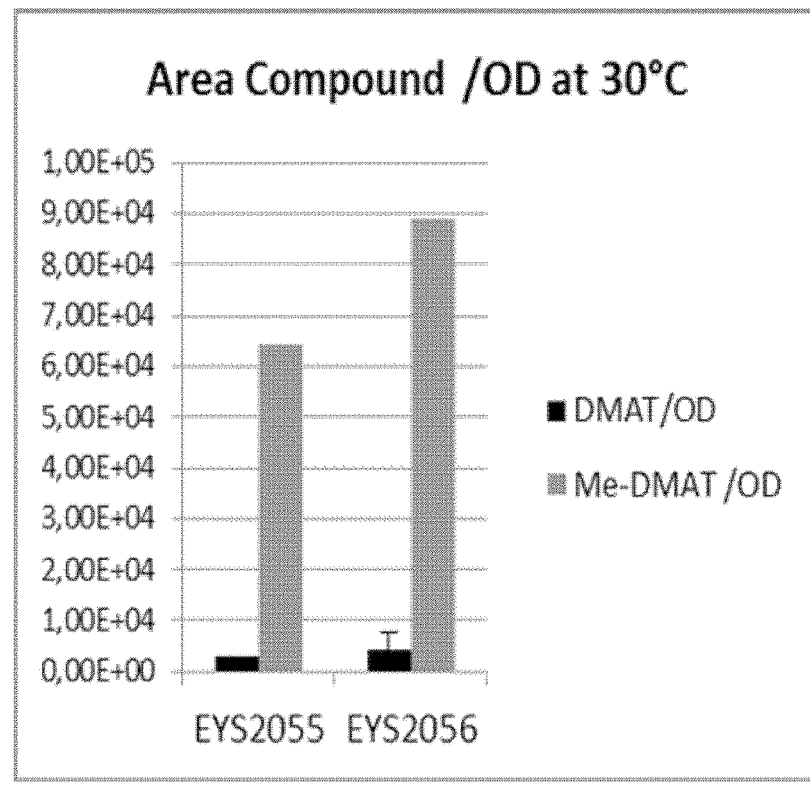

FIGS. 20a and 20b Production of DMAT and Me-DMAT in EYS2055 and EYS2056. Both express the two-step heterologous pathway to Me-DMAT. In addition, EYS2056 contains an extra, constitutively expressed copy of ScIdi1.

Figure 21:
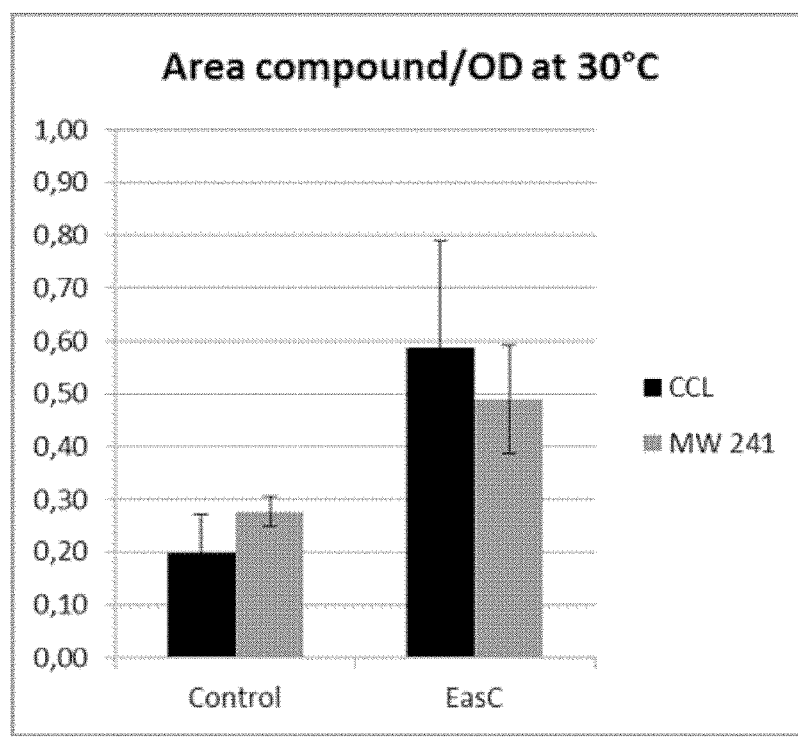
Figure 22:
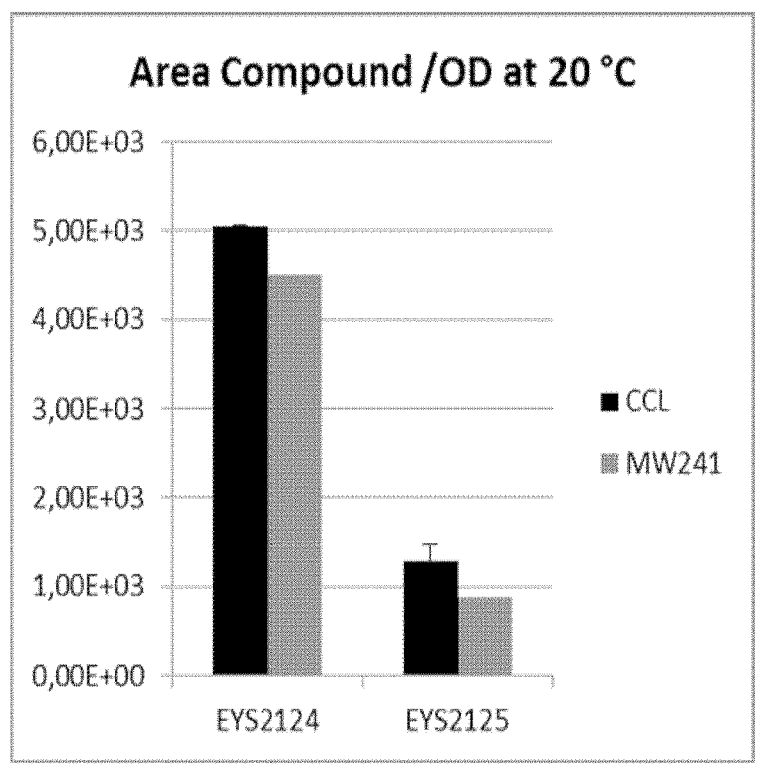

FIG. 21 Production of Cycloclavine (CCL) and Festuclavine (MW241) in EYS1934 (Control) and EYS2206 (EasC) was analysed and showed an increased production in EYS2206 due to the expression of the additional copy of the gene AjEasC FIG. 22: Analysis of culture supernatant from EYS2124 (EasE from *A. japonicus*) and EYS2125 (EasE from *N. lolii*) showing the relative amounts (area under the curve) of Cycloclavine and Festuclavine (MW241) produced by these strains.

Figure 23:
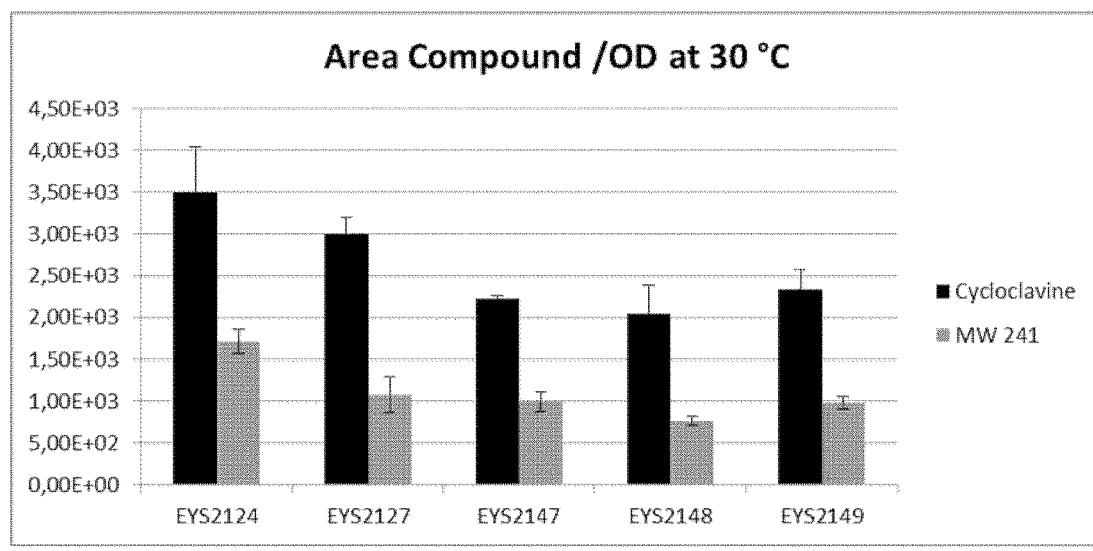

FIG. 23 Analysis of culture supernatant from yeast strains with full length cycloclavine pathways, each having an EasE gene with different DNA codon usage, but all encoding the corresponding enzyme from *A. japonicus*. The different codon usage results in varying amounts (depicted as area under the curve) of cycloclvine and Festuclavine (MW241) being produced by these strains.

Figure 24:
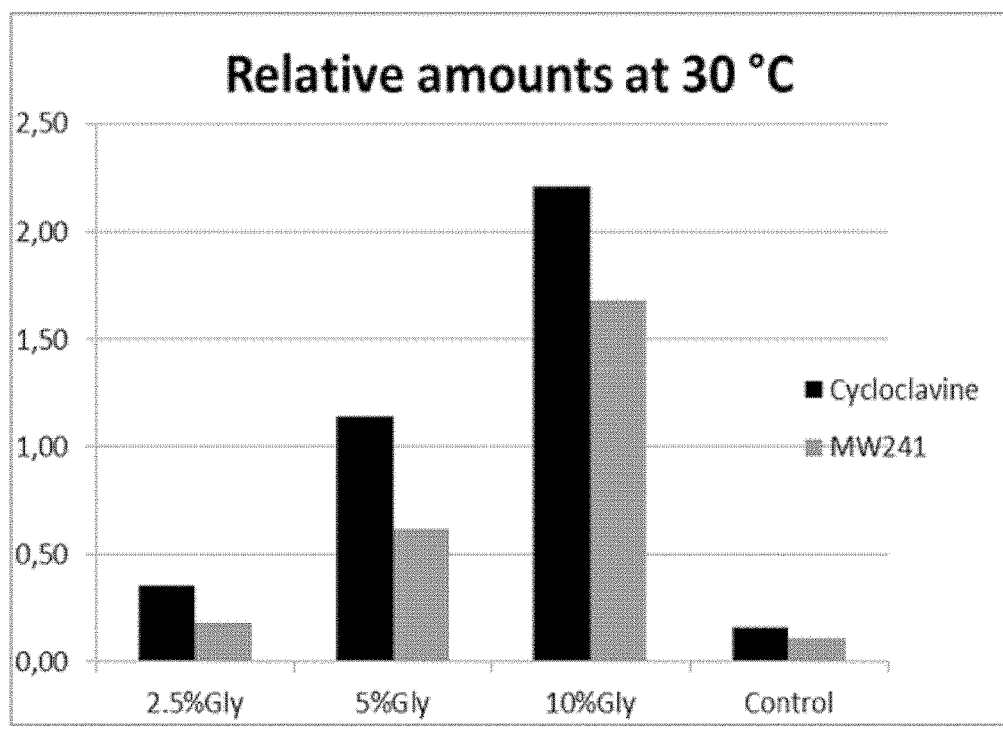

FIG. 24: EYS2006 was grown without (Control) or with 2.5%, 5%, and 10% glycerol, respectively. The production of cycloclavine and of Festuclavine (MW241) increased with increasing concentrations of glycerol.

Figure 25:
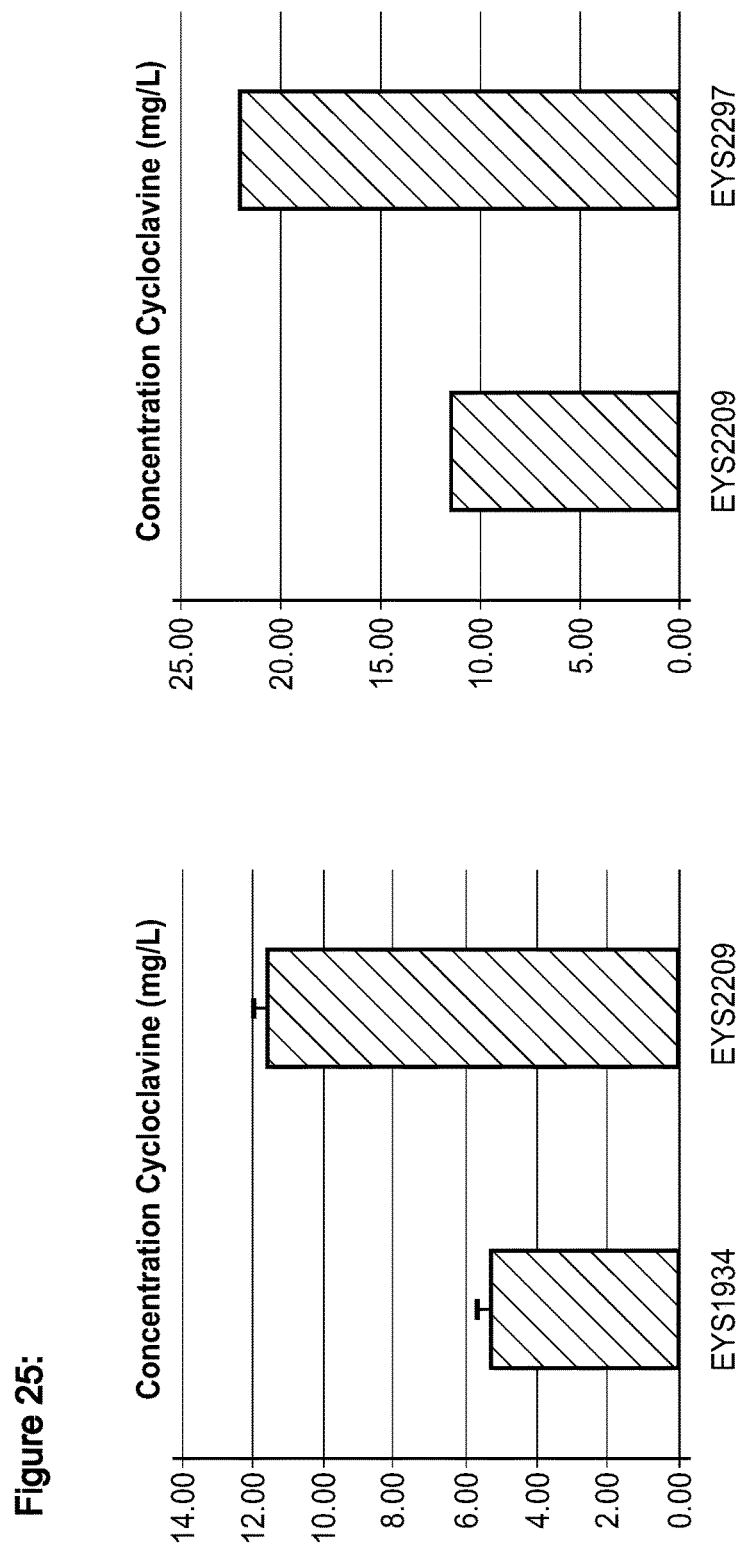

FIG. 25: Production of cycloclavine in EYS1934 compared to EYS2209 (left), and EYS2209 compared to EYS2297.

Figure 26:
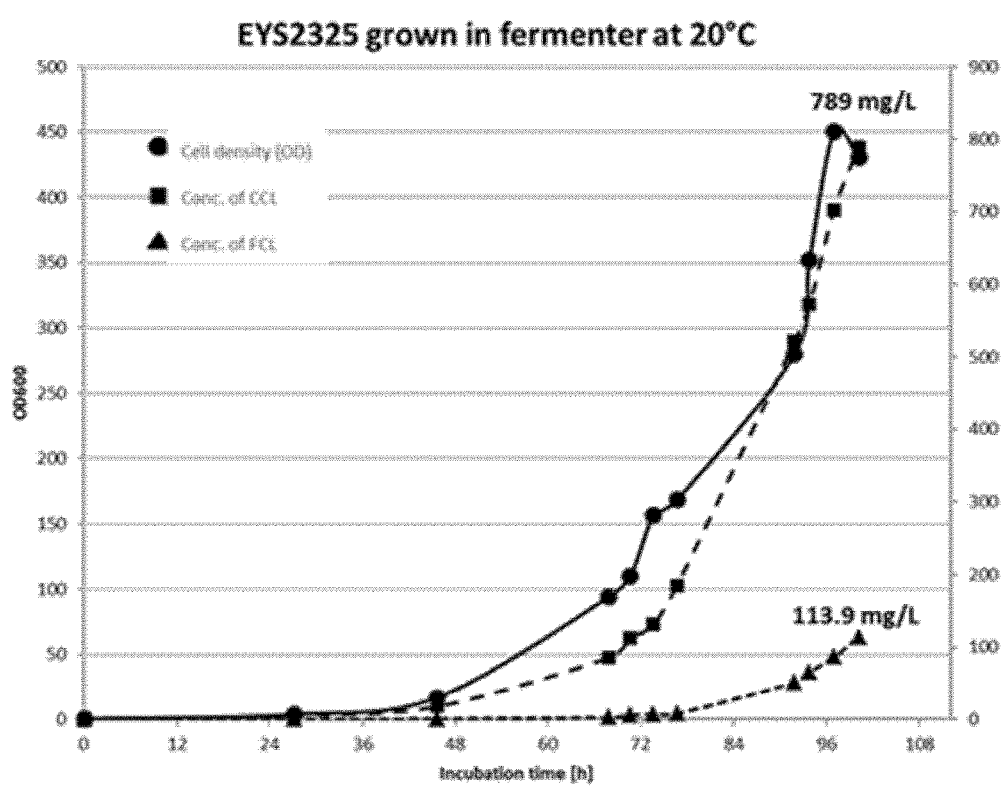

FIG. 26: Production of CCL and FCL in a fed-batch fermentation. Concentration of compound (mg/L), and the measured OD600, is shown for the duration of the fermentation.

Figure 27:
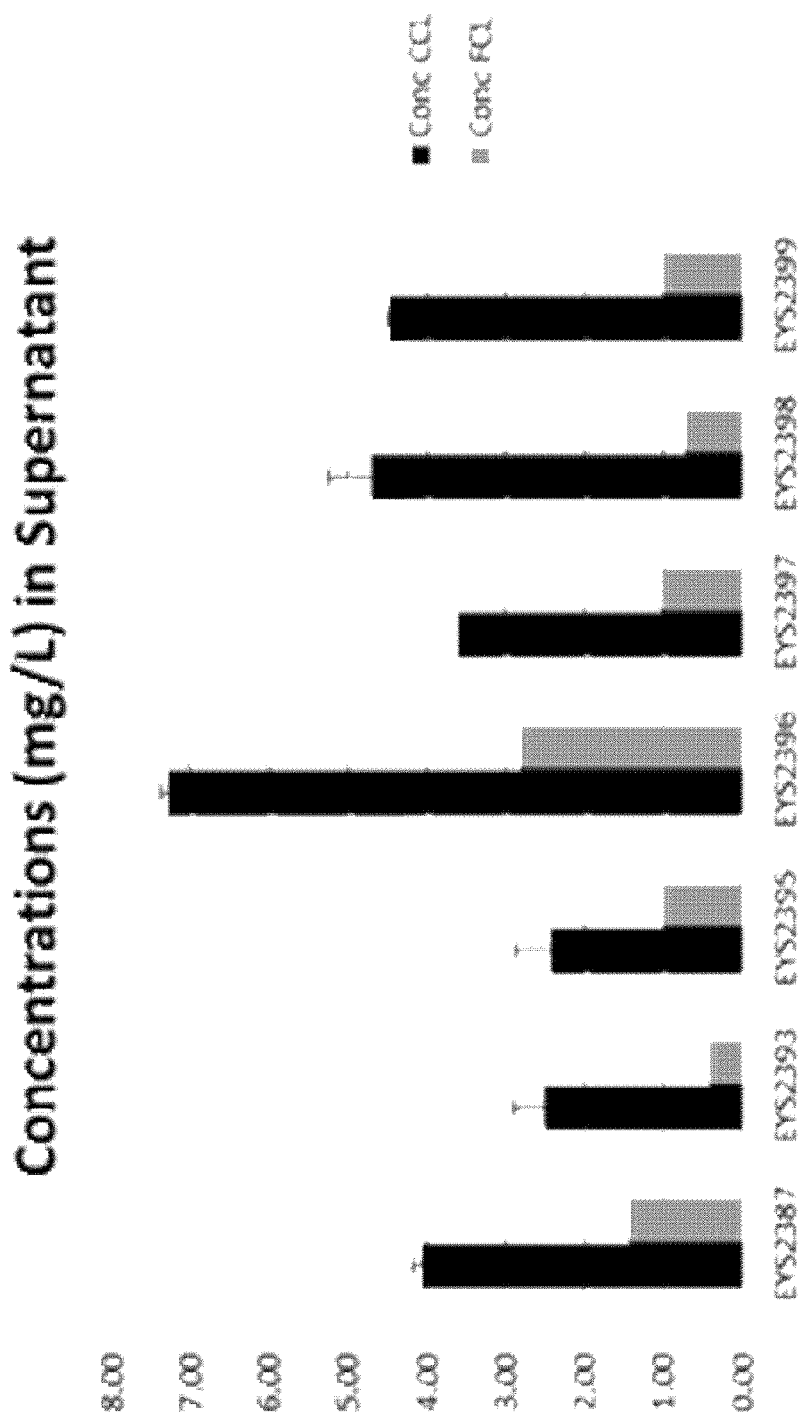

FIG. 27: Production of CCL and FCL in 7 yeast strains (*Saccharomyces cerevisiae*) with different genetic background (see Table 58).

GENERAL DEFINITIONS

The term "Cycloclavine" means a compound of Formula (I)

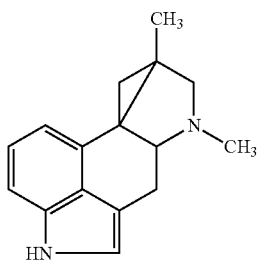

Formula (I)

The term "Festuclavine" means a compound of Formula (II)

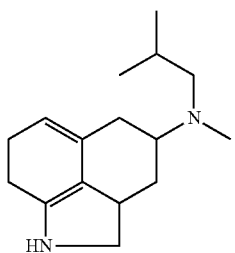

Formula (II)

The term "Agroclavine" means a compound of Formula (III)

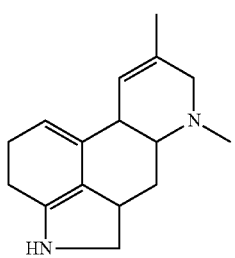

Formula (III)

The term "Chanoclavine aldehyde" means a compound of Formula (IV)

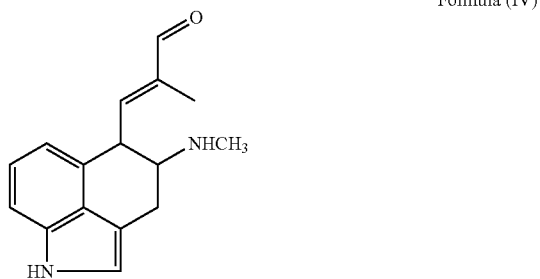

Formula (IV)

The term "Chanoclavine I" means a compound of Formula (V)

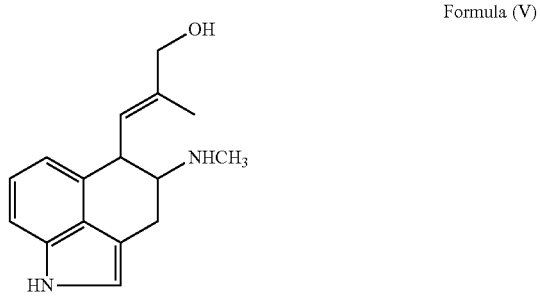 [SMILES: CNC1Cc2c[nH]c3cccc(c23)C1/C=C(\C)CO]

Formula (V)

The term "ME-DMAT" means a compound of the Formula (VI)

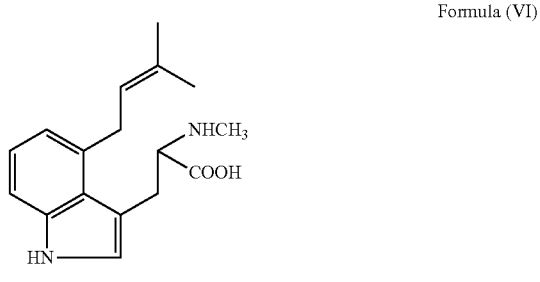 [SMILES: CNC(Cc1c[nH]c2cccc(CC=C(C)C)c12)C(=O)O]

Formula (VI)

The term "DMAT" means a compound of Formula (VII)

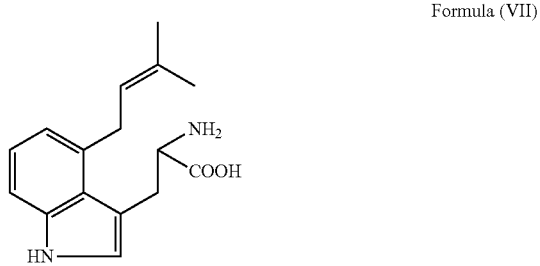 [SMILES: CC(C)=CCc1cccc2[nH]cc(CC(N)C(=O)O)c12]

Formula (VII)

The term "DMAPP" means a compound of Formula (VIII)

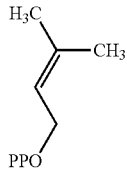

Formula (VIII)

The term "Tryptophane" means the amino acid Tryptophane, preferably L-Tryptophane, or one of its salts.

The term "IPP" means Isopentenyl pyrophosphate a compound of Formula (IX) or one of its salts.

The term "DmaW activity" means the capacity of a polypeptide or a microorganism comprising such a polypeptide to fulfill the same or a similar function than a polypeptide of SEQ ID NO: 1, i.e. to have Dimethylallyltryptophan synthase activity and to catalyze the prenylation of L-Tryptophane at position C4 resulting in the formation of 4-dimethylallyltryptophan ((S)-4-(3-methyl-2-butenyl)-tryptophan, or DMAT).

The term "EasF activity" means the capacity of a polypeptide or a microorganism comprising such a polypeptide, to fulfill the same or a similar function than a polypeptide of SEQ ID NO: 6, i.e. to have N-methyltransferase activity and to catalyze the methylation of DMAT to Me-DMAT.

The term "EasE activity" means the capacity of a polypeptide or a microorganism comprising such a polypeptide, to fulfill the same or a similar function than a polypeptide of SEQ ID NO: 5, i.e. to catalyze the conversion of Me-DMAT to Chanoclavine I, in case an EasC activity is also present.

The term "EasC activity" means the capacity of a polypeptide or a microorganism comprising such a polypeptide, to fulfill the same or a similar function than a polypeptide of SEQ ID NO: 3, i.e. to catalyze the conversion of Me-DMAT to Chanoclavine I in case an EasE activity is present as well.

The term "EasD activity" means the capacity of a polypeptide or a microorganism comprising such a polypeptide, to fulfill the same or a similar function than a polypeptide of SEQ ID NO: 4, i.e. to have oxidoreductase activity and to catalyze the conversion of Chanoclavine I to Chanoclavine aldehyde.

The term "EasH activity" means the capacity of a polypeptide or a microorganism comprising such a polypeptide, to fulfill the same or a similar function than a polypeptide of SEQ ID NO: 8, i.e to catalyze the conversion of Chanoclavine I to Cycloclavine, if an EasD, EasA and EasG activity is also present.

The term "EasA reductase activity" means the capacity of a polypeptide or a microorganism comprising such a polypeptide, to fulfill the same or a similar function than a polypeptide of SEQ ID NO: 2, i.e. to have reductase activity and to catalyze the conversion of Chanoclavine aldehyde to Festuclavine, if an EasG activity is present.

The term "EasA isomerase activity" means the capacity of a polypeptide or a microorganism comprising such a polypeptide, to fulfill the same or a similar function than a polypeptide of SEQ ID NO: 37 (C. purpurea EasA), i.e. to have isomerase activity and to catalyze the conversion of Chanoclavine aldehyde to Agroclavine, if an EasG activity is present.

The term "EasA activity" means the capacity of a polypeptide or a microorganism comprising such a polypeptide, to fulfill the same or a similar function than a polypeptide of SEQ ID NO: 2 or 37, i.e. to have either EasA reductase or EasA isomerase activity or to have both activities, as, for example, the polypeptide of Neotyphodium lolii of SEQ ID NO: 33, comprising a mutation from Y to F at position 18 of SEQ ID NO: 149).

The term "EasG activity" means the capacity of a polypeptide or a microorganism comprising such a polypeptide, to fulfill the same or a similar function than a polypeptide of SEQ ID NO: 7, i.e. to have oxidoreductase activity and to catalyze the conversion of Chanoclavine aldehyde to Agroclavine and/or Festuclavine, depending on the EasA activity present and/or to catalyze the conversion of Chanoclavine I to Cycloclavine, if an EasA, EasD and EasH activity is also present.

The term "ERG9 activity" means the capacity of a polypeptide or a microorganism comprising such a polypeptide to join two farnesyl pyrophosphate (FPP) moieties to form squalene in the sterol biosynthesis pathway. An ERG9 activity is usually provided by a squalene synthase.

The term "ERG20 activity" means the capacity of a polypeptide or a microorganism comprising such a polypeptide, to catalyze the formation of C15 farnesyl pyrophosphate units for isoprenoid and sterol biosynthesis.

The term "HMG-CoA reductase activity" means the capacity of a polypeptide or a microorganism comprising such a polypeptide, to catalyze the conversion of HMG-CoA to Mevalonate.

The term "about" is used herein to mean approximately, roughly, around, or in the region of. When the term "about" is used in conjunction with a numerical range, it modifies that range by extending the boundaries above and below the numerical values-set forth. In general, the term "about" is used herein to modify a numerical value above and below the stated value by a variance of 20 percent up or down (higher or lower), preferably 15 percent, more preferably 10 percent and most preferably 5 percent.

The term "genome" or "genomic DNA" is referring to the heritable genetic information of a host organism. Said genomic DNA comprises the entire genetic material of a cell or an organism, including the DNA of the nucleus (chromosomal DNA), extrachromosomal DNA, and organellar DNA (e.g. of mitochondria). Preferably, the terms genome or genomic DNA is referring to the chromosomal DNA of the nucleus.

The term "chromosomal DNA" or "chromosomal DNA sequence" is to be understood as the genomic DNA of the cellular nucleus independent from the cell cycle status. Chromosomal DNA might therefore be organized in chromosomes or chromatids, they might be condensed or uncoiled. An insertion into the chromosomal DNA can be demonstrated and analyzed by various methods known in the art like e.g., polymerase chain reaction (PCR) analysis, Southern blot analysis, fluorescence in situ hybridization (FISH), in situ PCR and next generation sequencing (NGS).

The term "promoter" refers to a polynucleotide which directs the transcription of a structural gene to produce mRNA. Typically, a promoter is located in the 5' region of a gene, proximal to the start codon of a structural gene. If a promoter is an inducible promoter, then the rate of transcription increases in response to an inducing agent. In contrast, the rate of transcription is not regulated by an inducing agent, if the promoter is a constitutive promoter.

The term "enhancer" refers to a polynucleotide. An enhancer can increase the efficiency with which a particular gene is transcribed into mRNA irrespective of the distance or orientation of the enhancer relative to the start site of transcription. Usually an enhancer is located close to a promoter, a 5'-untranslated sequence or in an intron.

A polynucleotide sequence is "heterologous to" an organism or a second polynucleotide sequence if it originates from a foreign species, or, if from the same species, is modified from its original form. For example, a promoter operably linked to a heterologous coding sequence refers to a coding sequence from a species different from that from which the promoter was derived, or, if from the same species, a coding sequence which is not naturally associated with the promoter (e.g. a genetically engineered coding sequence or an allele from a different ecotype or variety).

"Transgene", "transgenic" or "recombinant" refers to a polynucleotide manipulated by man or a copy or complement of a polynucleotide manipulated by man. For instance, a transgenic expression cassette comprising a promoter operably linked to a second polynucleotide may include a promoter that is heterologous to the second polynucleotide as the result of manipulation by man (e.g., by methods described in Sambrook et al., Molecular Cloning—A Laboratory Manual, Cold Spring Harbor Laboratory, Cold Spring Harbor, N.Y., (1989) or Current Protocols in Molecular Biology Volumes 1-3, John Wiley & Sons, Inc. (1994-1998)) of an isolated nucleic acid comprising the expression cassette. In another example, a recombinant expression cassette may comprise polynucleotides combined in such a way that the polynucleotides are extremely unlikely to be found in nature. For instance, restriction sites or plasmid vector sequences manipulated by man may flank or separate the promoter from the second polynucleotide. One of skill will recognize that polynucleotides can be manipulated in many ways and are not limited to the examples above.

In case the term "recombinant" is used to specify an organism or cell, e.g. a microorganism, it is used to express that the organism or cell comprises at least one "Transgene", "transgenic" or "recombinant" polynucleotide, which is usually specified later on.

A polynucleotide "exogenous to" an individual organism is a polynucleotide which is introduced into the organism by any means other than by a sexual cross.

The terms "operable linkage" or "operably linked" are generally understood as meaning an arrangement in which a genetic control sequence, e.g. a promoter, enhancer or terminator, is capable of exerting its function with regard to a polynucleotide being operably linked to it, for example a polynucleotide encoding a polypeptide. Function, in this context, may mean for example control of the expression, i.e. transcription and/or translation, of the nucleic acid sequence. Control, in this context, encompasses for example initiating, increasing, governing or suppressing the expression, i.e. transcription and, if appropriate, translation. Controlling, in turn, may be, for example, tissue- and/or time-specific. It may also be inducible, for example by certain chemicals, stress, pathogens and the like. Preferably, operable linkage is understood as meaning for example the sequential arrangement of a promoter, of the nucleic acid sequence to be expressed and, if appropriate, further regulatory elements such as, for example, a terminator, in such a way that each of the regulatory elements can fulfill its function when the nucleic acid sequence is expressed. An operably linkage does not necessarily require a direct linkage in the chemical sense. Genetic control sequences such as, for example, enhancer sequences are also capable of exerting their function on the target sequence from positions located at a distance to the polynucleotide, which is operably linked. Preferred arrangements are those in which the nucleic acid sequence to be expressed is positioned after a sequence acting as promoter so that the two sequences are linked covalently to one another. The distance between the promoter sequence and the nucleic acid sequence in an expression cassette, is preferably less than 200 base pairs, especially preferably less than 100 base pairs, very especially preferably less than 50 base pairs. The skilled worker is familiar with a variety of ways in order to obtain such an expression cassette. However, an expression cassette may also be constructed in such a way that the nucleic acid sequence to be expressed is brought under the control of an endogenous genetic control element, for example an endogenous promoter, for example by means of homologous recombination or else by random insertion. Such constructs are likewise understood as being expression cassettes for the purposes of the invention.

The term "expression cassette" means those construct in which the polynucleotide sequence to be expressed is linked operably to at least one genetic control element which enables or regulates its expression (i.e. transcription and/or translation). The expression may be, for example, stable or transient, constitutive or inducible.

The terms "express," "expressing," "expressed" and "expression" refer to expression of a gene product (e.g., a biosynthetic enzyme of a gene of a pathway or reaction defined and described in this application) at a level that the resulting enzyme activity of this protein encoded for, or the pathway or reaction that it refers to allows metabolic flux through this pathway or reaction in the organism in which this gene/pathway is expressed in. The expression can be done by genetic alteration of the microorganism that is used as a starting organism. In some embodiments, a microorganism can be genetically altered (e.g., genetically engineered) to express a gene product at an increased level relative to that produced by the starting microorganism or in a comparable microorganism which has not been altered. Genetic alteration includes, but is not limited to, altering or modifying regulatory sequences or sites associated with expression of a particular gene (e.g. by adding strong promoters, inducible promoters or multiple promoters or by removing regulatory sequences such that expression is constitutive), modifying the chromosomal location of a particular gene, altering nucleic acid sequences adjacent to a particular gene such as a ribosome binding site or transcription terminator, increasing the copy number of a particular gene, modifying proteins (e.g., regulatory proteins, suppressors, enhancers, transcriptional activators and the like) involved in transcription of a particular gene and/or translation of a particular gene product, or any other conventional means of deregulating expression of a particular gene using routine in the art (including but not limited to use of antisense nucleic acid molecules, for example, to block expression of repressor proteins).

In some embodiments, a microorganism can be physically or environmentally altered to express a gene product at an increased or lower level relative to level of expression of the gene product unaltered microorganism. For example, a microorganism can be treated with, or cultured in the presence of an agent known, or suspected to increase transcription of a particular gene and/or translation of a particular gene product such that transcription and/or translation are enhanced or increased. Alternatively, a microorganism can be cultured at a temperature selected to increase transcription of a particular gene and/or translation of a particular gene product such that transcription and/or translation are enhanced or increased.

The terms "deregulate," "deregulated" and "deregulation" refer to alteration or modification of at least one gene in a microorganism, wherein the alteration or modification results in increasing efficiency of production of a given compound in the microorganism relative to production in absence of the alteration or modification. In some embodiments, a gene that is altered or modified encodes an enzyme in a biosynthetic pathway, or a transport protein, such that the level or activity of the biosynthetic enzyme in the microorganism is altered or modified, or that the transport specificity or efficiency is altered or modified. In some embodiments, at least one gene that encodes an enzyme in a biosynthetic pathway, i.e. a polypeptide bringing about a specific activity in the biosynthetic pathway, for example an EasH activity, is altered or modified such that the level or activity of the enzyme is enhanced or increased relative to the level in presence of the unaltered or wild type gene.

Deregulation also includes altering the coding region of one or more genes to yield, for example, an enzyme that is feedback resistant or has a higher or lower specific activity. Also, deregulation further encompasses genetic alteration of genes encoding transcriptional factors (e.g., activators, repressors) which regulate expression of genes coding for enzymes or transport proteins. The terms "deregulate," "deregulated" and "deregulation" can further be specified in regard to the kind of deregulation present.

In case the particular activity, e.g. an EasH activity, is altered or modified such that the level or activity of the enzyme is enhanced or increased relative to the level in presence of the unaltered or wild type gene, the term "up-regulated" is used. In case particular activity, e.g. an ERG9 activity, is altered or modified such that the level or activity of the enzyme is lowered or decreased relative to the level in presence of the unaltered or wild type gene, the term "down-regulated" is used.

The terms "overexpress", "overexpressing", "overexpressed" and "overexpression" refer to expression of a gene product, in particular to enhancing the expression of a gene product at a level greater than that present prior to a genetic alteration of the starting microorganism. In some embodiments, a microorganism can be genetically altered (e.g., genetically engineered) to express a gene product at an increased level relative to that produced by the starting microorganism. Genetic alteration includes, but is not limited to, altering or modifying regulatory sequences or sites associated with expression of a particular gene (e.g., by adding strong promoters, inducible promoters or multiple promoters or by removing regulatory sequences such that expression is constitutive), modifying the chromosomal location of a particular gene, altering nucleic acid sequences adjacent to a particular gene such as a ribosome binding site or transcription terminator, increasing the copy number of a particular gene, modifying proteins (e.g., regulatory proteins, suppressors, enhancers, transcriptional activators and the like) involved in transcription of a particular gene and/or translation of a particular gene product, or any other conventional means of deregulating expression of a particular gene using routine in the art (including but not limited to use of antisense nucleic acid molecules, for example, to block expression of repressor proteins). Another way to overexpress a gene product is to enhance the stability of the gene product to increase its life time.

The term "deregulated" includes expression of a gene product at a level lower or higher than that expressed prior to manipulation of the microorganism or in a comparable microorganism which has not been manipulated. In one embodiment, the microorganism can be genetically manipulated (e.g., genetically engineered) to express a level of gene product at a lesser or higher level than that expressed prior to manipulation of the microorganism or in a comparable microorganism which has not been manipulated. Genetic manipulation can include, but is not limited to, altering or modifying regulatory sequences or sites associated with expression of a particular gene (e.g., by removing strong promoters, inducible promoters or multiple promoters), modifying the chromosomal location of a particular gene, altering nucleic acid sequences adjacent to a particular gene such as a ribosome binding site or transcription terminator, decreasing the copy number of a particular gene, modifying proteins (e.g., regulatory proteins, suppressors, enhancers, transcriptional activators and the like) involved in transcription of a particular gene and/or translation of a particular gene product, or any other conventional means of deregulating expression of a particular gene routine in the art (including but not limited to use of antisense nucleic acid molecules, or other methods to knock-out or block expression of the target protein).

The term "deregulated gene activity" also means that a gene activity is introduced into a microorganism where the respective gene activity, e.g. the lysine decarboxylase activity, has not been observed before, e.g. by introducing a recombinant gene, e.g. a heterologous gene, in one or more copies into the microorganism preferably by means of genetic engineering.

The phrase "deregulated pathway or reaction" refers to a biosynthetic pathway or reaction in which at least one gene that encodes an enzyme in a biosynthetic pathway or reaction is altered or modified such that the level or activity of at least one biosynthetic enzyme is altered or modified. The phrase "deregulated pathway" includes a biosynthetic pathway in which more than one gene has been altered or modified, thereby altering level and/or activity of the corresponding gene products/enzymes. In some cases the ability to "deregulate" a pathway (e.g., to simultaneously deregulate more than one gene in a given biosynthetic pathway) in a microorganism arises from the particular phenomenon of microorganisms in which more than one enzyme (e.g., two or three biosynthetic enzymes) are encoded by genes occurring adjacent to one another on a contiguous piece of genetic material termed a "cluster" or "gene cluster" In other cases, in order to deregulate a pathway, a number of genes must be deregulated in a series of sequential engineering steps.

To express the deregulated genes according to the invention, the DNA sequence encoding the polypeptide must be operably linked to regulatory sequences that control transcriptional expression in an expression vector and then, introduced into either microorganism. In addition to transcriptional regulatory sequences, such as promoters and enhancers, expression vectors can include translational regulatory sequences and a marker gene which is suitable for selection of cells that carry the expression vector.

As used herein, a "substantially pure protein" or compound means that the desired purified protein or compound is essentially free from contaminating cellular components, as evidenced for a protein by a single band following poly-acrylamide-sodium dodecyl sulfate gel electrophoresis (SDS-PAGE). The term "substantially pure" is further meant to describe a molecule which is homogeneous by one or more purity or homogeneity characteristics used by those of skill in the art. For example, a substantially pure protein or compound will show constant and reproducible characteristics within standard experimental deviations for parameters such as the following: molecular weight, chromatographic migration, amino acid composition, amino acid sequence, blocked or unblocked N-terminus, HPLC elution profile, biological activity, and other such parameters. The term, however, is not meant to exclude artificial or synthetic variants of the protein or artificial mixtures of two or more selected compounds. In particular, the term is not meant to exclude fusion proteins isolated from a recombinant host, e.g. fusions of proteins to a tag for affinity purification.

The term "sequence identity" between two nucleic acid sequences is understood as meaning the percent identity of the nucleic acid sequence over in each case the entire sequence length which is calculated by alignment with the aid of the program algorithm GAP (Wisconsin Package Version 10.0, University of Wisconsin, Genetics Computer Group (GCG), Madison, USA), setting the following parameters:
Gap Weight: 12 Length Weight: 4
Average Match: 2,912 Average Mismatch: −2,003

The term "sequence identity" between two amino acid sequences is understood as meaning the percent identity of the nucleic acid sequence over in each case the entire sequence length which is calculated by alignment with the aid of the program algorithm GAP (Wisconsin Package Version 10.0, University of Wisconsin, Genetics Computer Group (GCG), Madison, USA), setting the following parameters:
Gap Weight: 8 Length Weight: 2
Average Match: 2,912 Average Mismatch: −2,003

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002) & The Pfam protein families database: R. D. Finn, J. Mistry, J. Tate, P. Coggill, A. Heger, J. E. Pollington, O. L. Gavin, P. Gunesekaran, G. Ceric, K. Forslund, L. Holm, E. L. Sonnhammer, S. R. Eddy, A. Bateman Nucleic Acids Research (2010) Database Issue 38:D211-222). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788(2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Typically, this involves a first BLAST involving BLASTing a query sequence against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The $T_m$ is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the $T_m$ decreases about 1° C. per % base mismatch. The $T_m$ may be calculated using the following equations, depending on the types of hybrids:

1) DNA-DNA hybrids (Meinkoth and Wahl, Anal. Biochem., 138: 267-284, 1984):

$$T_m=81.5° C.+16.6 \times \log_{10}[Na^+]^a+0.41 \times \%[G/C^b]-500 \times [L^c]^{-1}-0.61 \times \% \text{ formamide}$$

2) DNA-RNA or RNA-RNA hybrids:

$$T_m=79.8° C.+18.5(\log_{10}[Na^+]^a)+0.58(\%G/C^b)+11.8(\%G/C^b)^2-820/L^c$$

3) oligo-DNA or oligo-RNAs hybrids:

For <20 nucleotides: $T_m=2(l_n)$

For 20-35 nucleotides: $T_m=22+1.46(l_n)$

[a] or for other monovalent cation, but only accurate in the 0.01-0.4 M range.
[b] only accurate for % GC in the 30% to 75% range.
[c] L=length of duplex in base pairs.
[d] oligo, oligonucleotide; $l_n$=effective length of primer=2× (no. of G/C)+(no. of NT).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or
(ii) progressively lowering the formamide concentration (for example from 50% to 0%).

The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast twohybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions | Residue | Conservative Substitutions |
| --- | --- | --- | --- |
| Ala | Ser | Leu | Ile; Val |
| Arg | Lys | Lys | Arg; Gln |
| Asn | Gln; His | Met | Leu; Ile |
| Asp | Glu | Phe | Met; Leu; Tyr |
| Gln | Asn | Ser | Thr; Gly |
| Cys | Ser | Thr | Ser; Val |
| Glu | Asp | Trp | Tyr |
| Gly | Pro | Tyr | Trp; Phe |
| His | Asn; Gln | Val | Ile; Leu |
| Ile | Leu, Val | | |

Reference herein to an "endogenous" gene not only refers to the gene in question as found in an organisms in its natural form (i.e., without there being any human intervention), but also refers to that same gene (or a substantially homologous nucleic acid/gene) in an isolated form subsequently (re) introduced into a microorganisms (a transgene). For example, a transgenic microorganism containing such a transgene may encounter a substantial reduction of the transgene expression and/or substantial reduction of expression of the endogenous gene. The isolated gene may be isolated from an organism or may be manmade, for example by chemical synthesis.

The terms "orthologues" and "paralogues" encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

DETAILED DESCRIPTION OF PREFERRED EMBODIMENTS

In a first aspect, the present invention provides recombinant microorganisms comprising at least one of the activities selected from the group of DmaW, EasF, EasE, EasC, EasD, EasH, EasA and EasG activities, wherein the EasA activity may be EasA reductase or EasA isomerase activity or may be EasA reductase and EasA isomerase activity and wherein the recombinant microorganism is not a natural ergot alkaloid producer organism.

Preferably the recombinant microorganism comprises at least one EasH and EasD activity, or comprises at least one EasH and EasA reductase activity, or comprises at least one EasH, EasA reductase and EasD activity, or comprises at least one EasH and EasD, EasA and EasG activity, even more preferred at least one EasH, EasD, EasA reductase and EasG activity.

In another embodiment, the recombinant microorganism comprises at least one DmaW, EasF, EasE, EasC, EasD, EasH, EasA and EasG activity, preferably at least one DmaW, EasF, EasE, EasC, EasD, EasH, EasA reductase and EasG activity.

In a further embodiment, the recombinant microorganism comprises at least one EasD, EasA and EasG activity, or at least one EasD, EasA reductase and EasG activity, or at least one EasD, EasA isomerase and EasG activity, or at least one EasD, EasA reductase, EasA isomerase and EasG activity.

The recombinant microorganism may also comprise at least one DmaW, EasF, EasE, EasC, EasD, EasA reductase and EasG activity, or one DmaW, EasF, EasE, EasC, EasD, EasA isomerase and EasG activity, or at least one DmaW, EasF, EasE, EasC, EasD, EasA reductase, EasA isomerase and EasG activity.

In a further embodiment, the recombinant microorganism comprises at least one DmaW, EasF, EasE and EasC activity, or at least one DmaW, EasF, EasE, EasC and EasD activity.

In one embodiment, the recombinant microorganism comprises at least two of the activities selected from the group of DmaW, EasF, EasE, EasC, EasD, EasH, EasA and EasG activities, wherein the EasA activity may be EasA reductase or EasA isomerase activity or may be EasA reductase and EasA isomerase activity, wherein these activities are mediated by polypeptides, which can be obtained from the same or from different natural ergot alkaloid producer organisms, for example, in one embodiment, the recombinant microorganism comprises at least an EasH and EasD, or at least an EasH and EasA, or at least an EasH, EasD and EasA activity obtainable from one species of natural ergot alkaloid producer organism or from different natural ergot alkaloid producer organisms. In a further exemplary embodiment the recombinant organism comprises at least an EasF and EasE, or at least an EasF and EasC, or at least an EasF, EasE and EasC activity obtainable from one species of natural ergot alkaloid producer organism A natural ergot alkaloid producer organism, is an organisms which occurs in nature and has the capacity to produce at least one type of ergot alkaloids. Natural ergot alkaloid producer organism belong to the Clavicipitaceae, Arthrodermataceae and Trichocomaceae, in particular *Arthroderma benhamiae, Claviceps* spec. *Neotyphodium* spec., *Epichloee* spec., *Sphacelia* spec., *Balansia* spec. or *Periglandula* spec., *Aspergillus* spec. and *Penicillium* spec, *Paecylomyces* spec., *Trichophyton* spec, *Arthoderma* spec, *Metarhizium* spec., *Hypocrea* spec, *Ajellomyces* spec., *Neurospora* spec. *Paracoccidioides* spec., *Botryotinia* spec. Examples of individual species of natural ergot alkaloid producer organisms are described throughout the disclosure of the invention.

Information on natural ergot alkaloid producer organism as well as on gene clusters for ergot alkaloid production can for example be found in: Schardl C L, Young C A, Hesse U, Amyotte S G, Andreeva K, et al. (2013) Plant-Symbiotic Fungi as Chemical Engineers: MultiGenome Analysis of the Clavicipitaceae Reveals Dynamics of Alkaloid Loci. PLoS Genet 9(2): e1003323. doi:10.1371/journal.pgen.1003323, and in: Schardl C L, et al.: "The epichloae: alkaloid diversity and roles in symbiosis with grasses", Curr Opin Plant Biol (2013), 16:1-9.

Preferably, said recombinant microorganism is a bacterium, a yeast, an actinomycete, or a filamentous fungus, which is not a natural ergot alkaloid producer organism. Such filamentous fungi can be an ascomycete, a deuteromycete, or a basidiomycete, a preferred species is *Schizophyllum commune*.

Preferred bacteria to be used as host cells of the present invention are selected from the group consisting of: *Escherichia coli* and *Bacilus subtilis*.

Preferred yeasts are selected from the group consisting of: *Kluyveromyces, Saccharomyces, Schizosaccharomyces, Yarrowia* and *Pichia*.

More preferred are recombinant microorganisms selected from the group consisting of: *Kluyveromyces lactis, Saccharomyces cerevisiae, Schizosaccharomyces pombe, Yarrowia lipolytica* and *Pichia stipites*.

Even more preferred, the recombinant microorganism is *Saccharomyces cerevisiae*.

The invention encompasses also recombinant natural ergot alkaloid producer organism having at least one up-regulated activity selected from the group of activities of: DmaW, EasF, EasE, EasC, EasD, EasH, EasA reductase, EasA isomerase and EasG activity.

In one embodiment, the recombinant natural ergot alkaloid producer organism comprises at least an up-regulated EasH and EasD, EasA and EasG activity, even more preferred an up-regulated EasH, EasD, EasA reductase and EasG activity.

In another embodiment, the recombinant natural ergot alkaloid producer organism comprises at least an up-regulated DmaW, EasF, EasE, EasC, EasD, EasH, EasA and EasG activity, preferably at least an up-regulated DmaW, EasF, EasE, EasC, EasD, EasH, EasA reductase and EasG activity.

In a further embodiment, the recombinant natural ergot alkaloid producer organism comprises at least an up-regulated EasD, EasA and EasG activity, or at least an up-regulated EasD, EasA reductase and EasG activity, or at least an up-regulated EasD, EasA isomerase and EasG activity, or at least an up-regulated EasD, EasA reductase, EasA isomerase and EasG activity.

The recombinant natural ergot alkaloid producer organism may also comprise at least a up-regulated DmaW, EasF, EasE, EasC, EasD, EasA reductase and EasG activity, or an up-regulated DmaW, EasF, EasE, EasC, EasD, EasA isomerase and EasG activity, or an up-regulated DmaW, EasF, EasE, EasC, EasD, EasA reductase, EasA isomerase and EasG activity.

In a further embodiment, the recombinant natural ergot alkaloid producer organism comprises at least an up-regulated DmaW, EasF, EasE and EasC activity, or an up-regulated DmaW, EasF, EasE, EasC and EasD activity.

In an even further embodiment, the recombinant natural ergot alkaloid producer organism comprises at least one down-regulated activity selected from the group of EasD, EasH, EasA reductase, EasA isomerase and EasG activity.

In one embodiment, the recombinant natural ergot alkaloid producer organism comprises at least one up-regulated activities selected from the group of DmaW, EasF, EasE, EasC, EasD, EasH, EasA and EasG activities, wherein the EasA activity may be EasA reductase or EasA isomerase activity or may be EasA reductase and EasA isomerase activity, wherein these activities are mediated by polypeptides, which are obtainable from the same or from different natural ergot alkaloid producer organisms, for example, in one embodiment, the recombinant microorganism comprises at least an EasH and EasD, or at least an EasH and EasA, or at least an EasH, EasD and EasA activity obtainable from one species of natural ergot alkaloid producer organism or from different natural ergot alkaloid producer organisms. In a further exemplary embodiment the recombinant organism comprises at least an EasF and EasE, or at least an EasF and EasC, or at least an EasF, EasE and EasC activity obtainable from one species of natural ergot alkaloid producer organism or from different natural ergot alkaloid producer organisms.

Preferably, the recombinant natural ergot alkaloid producer organism is selected from the group of the Clavicipitaceae, Arthrodermataceae and Trichocomaceae, in particular *Arthroderma benhamiae, Claviceps* spec. *Neotyphodium* spec., *Epichloee* spec., *Sphacelia* spec., *Balansia* spec. or *Periglandula* spec., *Aspergillus* spec. and *Penicillium* spec, *Paecylomyces* spec., *Trichophyton* spec, *Arthoderma* spec, *Metarhizium* spec., *Hypocrea* spec, *Ajellomyces* spec., *Neurospora* spec. *Paracoccidioides* spec., *Botryotinia* spec., or is selected from the group consisting of: The genus *Aspergillus*, in particular *Aspergillus japonicus, Aspergillus niger, Aspergillus oryzae, Aspergillus nidulans, Aspergillus fumigatus, Aspergillus aculeatus, Aspergillus caesiellus, Aspergillus candidus, Aspergillus carneus, Aspergillus clavatus, Aspergillus deflectus, Aspergillus fischerianus, Aspergillus flavus, Aspergillus glaucus, Aspergillus ochraceus, Aspergillus parasiticus, Aspergillus penicilloides, Aspergillus restrictus, Aspergillus sojae, Aspergillus tamari, Aspergillus terreus, Aspergillus ustus, Aspergillus versicolor*; More preferred, the recombinant natural ergot alkaloid producer organism is selected from the group consisting of: *Aspergillus fumigatus, Apergillus japonicus, Aspergillus nidulans* and *Aspergillus oryzae*, or
the genus *Penicillium* such as *Penicillium aurantiogriseum, Penicillium bilaiae, Penicillium camemberti, Penicillium candidum, Penicillium chrysogenum, Penicillium clavi-*

*forme, Penicillium commune, Penicillium citrinum, Penicillium corylophinum, Penicillium comune, Penicillium fellutanum, Penicillium waksmanii, Penicillium crustosum, Penicillium digitatum, Penicillium expansum, Penicillium funiculosum, Penicillium glabrum, Penicillium glaucum, Penicillium italicum, Penicillium lacussarmientei, Penicillium mameffei, Penicillium purpurogenum, Penicillium roqueforti, Penicillium stoloniferum, Penicillium ulaiense, Penicillium verrucosum, Penicillium viridicatum*; or
the genus *Claviceps* such as *Claviceps africana, Claviceps gigantea, Claviceps grohii, Claviceps cyperi, Claviceps fusiformis, Claviceps hirtella, Claviceps nigricans, Claviceps paspali, Claviceps purpurea, Claviceps sorghi, Claviceps zizaniae*, preferably *Claviceps africana, Claviceps paspali*, or *Claviceps purpurea*, or
the genus *Paecilomyces* such as *Paecilomyces divaricatus*, the genus *Arthroderma*, such as *Arthroderma benhamiae*, or the genus *Trichophyton*, such as *Trichophyton verrucosum*, or the genus *Microsporum*, such as *Microsporum canis*.

Even more preferred are recombinant natural ergot alkaloid producer organisms selected from the group consisting of: *Aspergillus japonicus, Aspergillus niger, Aspergillus oryzae, Aspergillus nidulans, Aspergillus fumigatus, Claviceps africana, Claviceps purpurea, Claviceps fusiformis, Claviceps paspali, Claviceps zizaniea, Penicillium chrysogenum, Penicillium citrinum, Penicillium corylophinum, Penicillium fellutanum, Penicillium waksmanii, Penicillium roqueforti*, and *Paecilomyces divaricatus*, preferably from the group consisting of: *Aspergillus japonicus, Aspergillus fumigatus, Claviceps purpurea, Claviceps paspali, Claviceps africana*, and *Paecilomyces divaricatus*.

Figure 1:
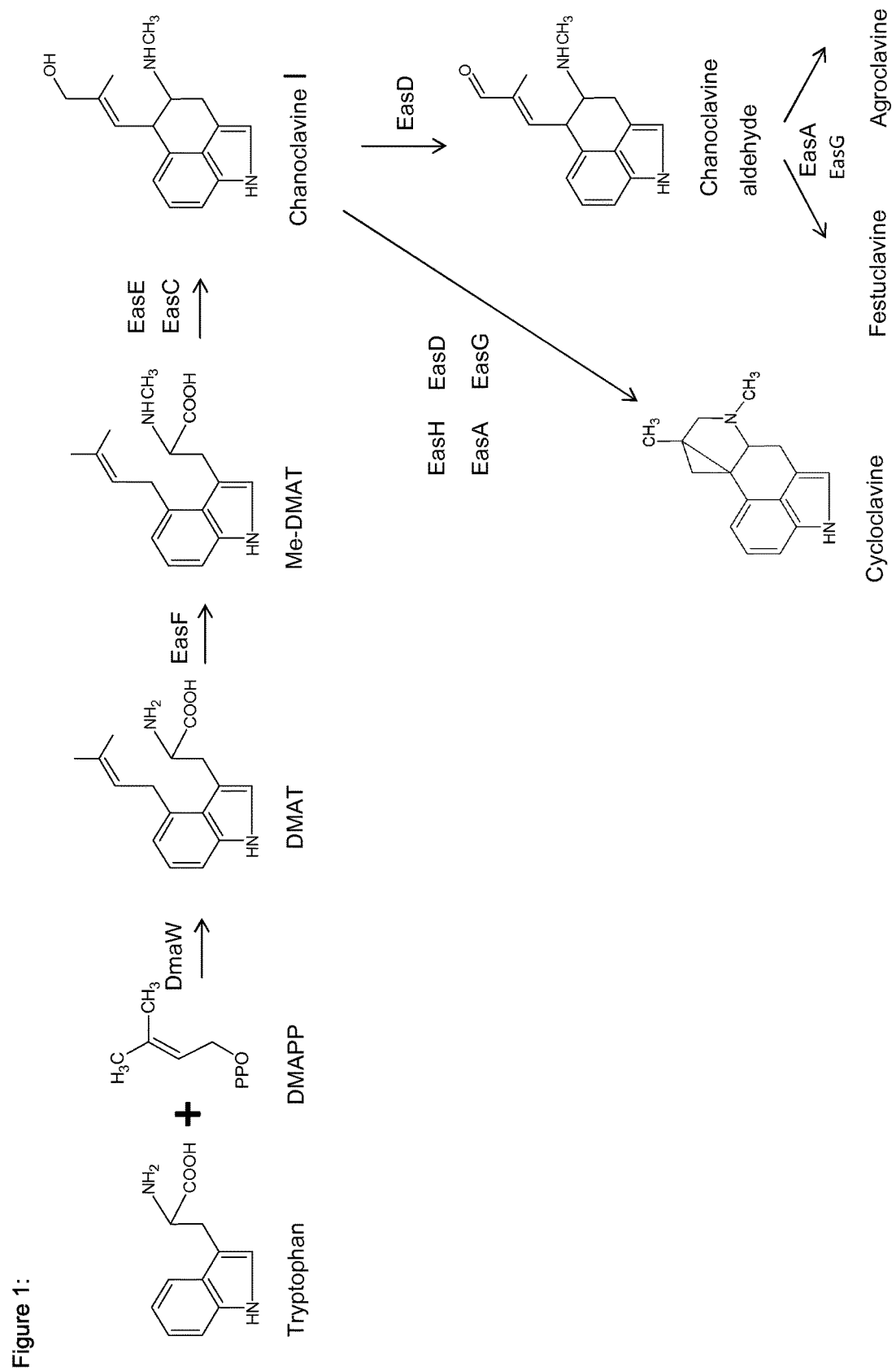
FIG. 1 represents a schematic drawing of the different steps of the metabolic pathway leading to Cycloclavine, or to Agroclavine and/or Festuclavine on the other branch of the pathway. The branch point of the pathway is located after Chanoclavine I has been synthesized, which is then further modified either by a combination of EasH, EasD, EasA and EasG activities in order to produce Cycloclavine, or Chanoclavine I is transformed to Chanoclavine aldehyde via an EasD activity and further modified via a combination of EasA and EasG activities to Agroclavine and/or Festuclavine, depending on the EasA activity present. The EasA activity may either be an EasA isomerase activity in the case of Agroclavine, or an EasA reductase activity in the case of Festuclavine.
Figure 2:
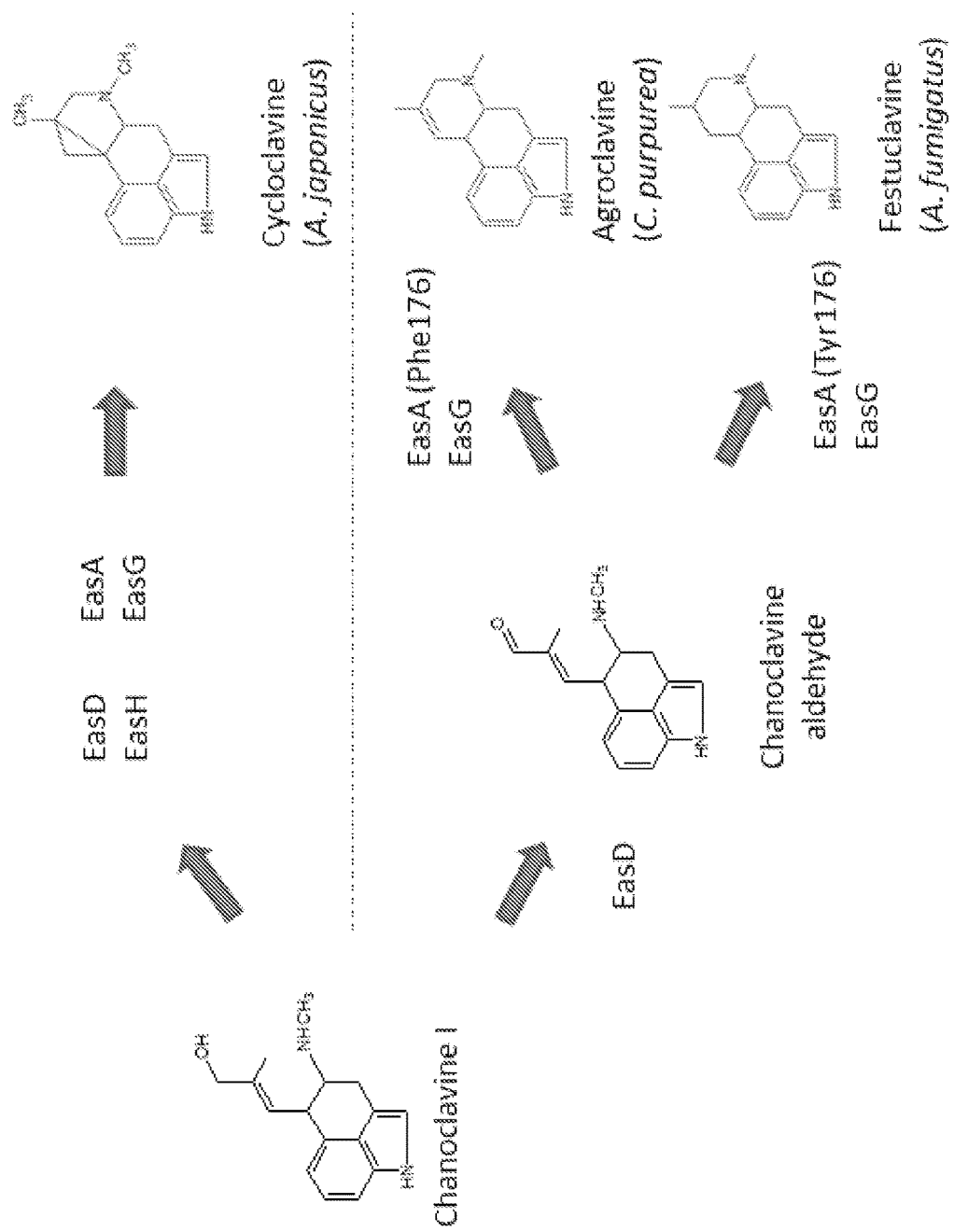
FIG. 2 represents a schematic drawing of the different steps and the different Eas activities involved in those steps of the metabolic pathway leading from Chanoclavine I either to Cycloclavine via a combination of EasD, EasH, EasA and EasG activities, or from Chanoclavine to Chanoclavine aldehyde via an EasD activity and from Chanoclavine aldehyde to Festuclavine via a combination of EasG and EasA reductase activity mediated by "EasA (Tyr176)", or leading from Chanoclavine aldehyde to Agroclavine via a combination of EasG and EasA isomerase activity mediated by "EasA (Phe176)".
Figure 3B:
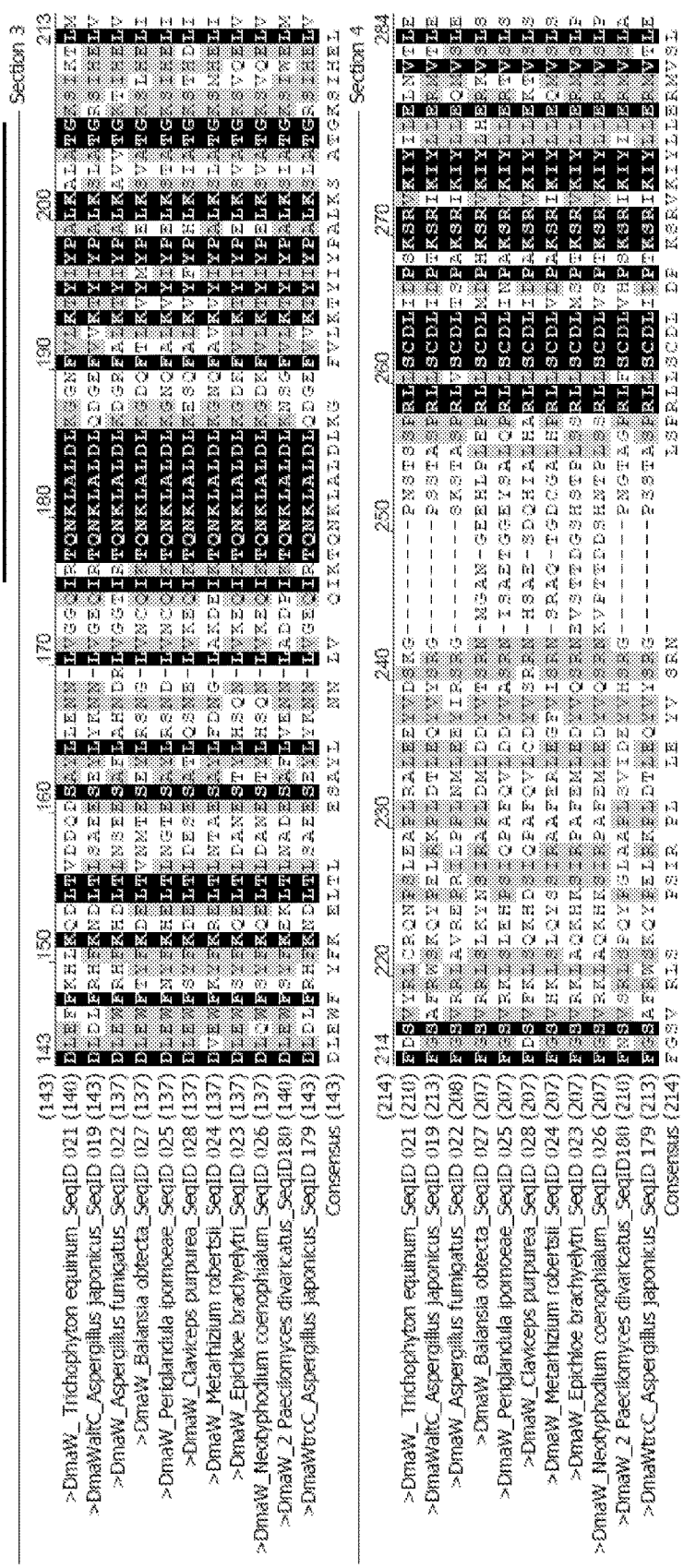

The recombinant natural ergot alkaloid producer organisms can be used to produce at least one of Cycloclavine, Festuclavine, Agroclavine, Chanoclavine aldehyde, or Chanoclavine I Further guidance on which activities should be up-regulated and/or down-regulated in order to provide more of Cycloclavine, Festuclavine, Agroclavine, Chanoclavine aldehyde, and/or Chanoclavine I is comprised in FIG. 1 and FIG. 2.

For example, a recombinant natural regot alkaloid producer organism is a *Claviceps paspali, Claviceps purpurea*, or *Claviceps aricana* cell having an up-regulated EasH activity, preferably having an up-regulated EasH and EasA reductase activity and a down-regulated EasA isomerase activity.

All the recombinant microorganisms or recombinant natural ergot alkaloid producer organisms described above do preferably comprise an enlarged cell internal supply of Tryptophan and/or of DMAPP and/or an enlarged cell internal supply of Me-DMAT. This enlarged cell internal supply of DMAPP and/or Me-DMAT can be provided, by up-regulating the activity of genes or polypeptides of the Mevalonate pathway or the recombinant microorganisms or recombinant natural ergot alkaloid producer organisms. Example of genes and polypeptides of the Mevalonate pathway of *Sacharromyces cerevisiae* are described by SEQ ID NO: 12, 13, 14, 15, 16, 17, or 18. Homologs of these genes and sequence variants thereof are readily available to the person skilled in the art.

For example, the recombinant microorganism or recombinant natural ergot alkaloid producer organism can comprise at least one down-regulated activity selected from the group of: ERG9, and ERG20, activity, or can comprise at least one up-regulated HMG-CoA reductase activity, or can comprise at least one down-regulated activity selected from the group of: ERG9 and ERG20, activity and at least one up-regulated HMG-CoA reductase activity.

Accordingly, the present invention, preferably, envisages recombinant microorganisms or recombinant natural ergot alkaloid producer organisms which, in addition to the polynucleotide of the present invention comprises, polynucleotides which are required or which facilitate the synthesis of tryptophan as the starting material for the synthesis of clavine-type alkaloids as referred to herein. More preferably, such an enzyme is the tryptophansynthase. More details on the biosynthesis of tryptophan may be found, e.g., in Radwanski 1995, Plant Cell 7(7): 921-934.

In one embodiment of the invention, the recombinant microorganism or recombinant natural ergot alkaloid producer organism as described above comprises at least one recombinant polynucleotide coding for at least one EasH activity, or coding for at least one EasH and EasD activity, or coding for at least one EasA reductase or at least one EasA isomerase activity, or coding for at least one EasD, EasA isomerase and EasG activity, or coding for at least one EasD, EasA reductase and EasG activity, or coding for at least one EasH, EasD, EasA reductase, EasA isomerase and EasG activity, or coding for at least one EasH, EasD, EasA reductase and EasG activity, or coding for at least one EasH, EasD, EasA isomerase and EasG activity, or coding for at least one DmaW, EasF, EasE and EasC activity, or coding for at least two of the alternatives described above.

Accordingly, a further embodiment of the invention is a recombinant polynucleotide coding for at least one EasH activity, or coding for at least one EasH and EasD activity, or coding for at least one EasA reductase or at least one EasA isomerase activity, or coding for at least one EasD, EasA isomerase and EasG activity, or coding for at least one EasD, EasA reductase and EasG activity, or coding for at least one EasH, EasD, EasA reductase, EasA isomerase and EasG activity, or coding for at least one EasH, EasD, EasA reductase and EasG activity, or coding for at least one EasH, EasD, EasA isomerase and EasG activity, or coding for at least one DmaW, EasF, EasE and EasC activity, or coding for at least two of the alternatives described above.

The DmaW activity of any one of the recombinant microorganism or recombinant natural ergot alkaloid producer organism or recombinant polynucleotides as described for this invention is preferably due to the activity of at least one polypeptide or at least one polynucleotide coding for at least one polypeptide selected from the group of:
a) a polypeptide comprising an amino acid sequence having at least 90%, 91%, 92%, 93%, 94%, 95%, 96%, 97%, 98%, 99%, or 100% sequence identity to SEQ ID NO: 145 and 146,
b) a polypeptide comprising an amino acid sequence having at least 90%, 91%, 92%, 93%, 94%, 95%, 96%, 97%, 98%, 99%, or 100% sequence identity to SEQ ID NO: 147 and or 190,
c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20 179, and/or 180,
d) a polypeptide comprising an amino acid sequence having at least 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28,
e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 102, 122 and/or 123, f) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 129 and/or 137, g) a polypeptide encoded by a polynucleotide obtainable with two PCR-Primers, each comprising at least 15 consecutive nucleotides of a polynucleotide sequence selected from the group of sequences described by SEQ ID NO: 102, 122, 123, 129 and/or 137, h) a polypeptide encoded by a polynucleotide which hybridizes under stringent conditions to SEQ ID NO: 102, 122, 123 129 and/or 137, i) a polypeptide according to at least two of a) to h), preferably according to at least b) and c) and j) a polypeptide according to at least one of a) to i) which is obtainable from a natural ergot alkaloid producer organism.

A polynucleotide encoding a polypeptide having DmaW activity can, in principle, be obtained from any of the natural ergot alkaloid producers mentioned herein. In one embodiment, the polynucleotide is obtained from a natural ergot alkaloid producer selected from the group consisting of:

*Aspergillus terreus, Balansia andropogonis, Balansia cyperi, Balansia obtecta, Balansia pilulaeformis, Claviceps Africana, Claviceps fusiformis, Claviceps hirtella, Sphacelia eriochloae, Sphacelia texensis, Sphacelia lovelessii, Neotyphodium sp. Lp1, Neotyphodium coenophialum, Neotyphodium lolii, Penicillium citrinum, Penicillium commune, Penicillium corylophillum, Penicillium crustosum, Penicillium fellutanum* and *Penicillium palitans*, or is consisting of: *Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicillium fellutanum, Penicillium waksmanii, Penicillium roqueforti* and *Paecilomyces divaricatus*, or is consisting of: *Arthroderma benthamiae, Arthroderma otae, Epichloe brachyelytri, Epichloe festucae, Epichloe glyceriae, Epichloe typhina, Malbranchea aurantiaca, Microsporum canis, Metarhizium acridum, Metarhizium robertsii, Periglandula ipomoeae, Trichophyton equinum*, and *Trichophyton tonsurans*, or is consisting of: *Aspergillus japonicus, Aspergillus fumigatus, Claviceps purpurea*, and *Paecilomyces divaricatus*, or is consisting of a group being a combination of any one of these groups.

A polynucleotides encoding a polypeptide having DmaW activity can be obtained from the organisms listed above, by amplifying genomic fragments or cDNA fragments via PCR-methods, using PCR-primer, which have been designed based on the sequence information provided by the sequence information for polynucleotides encoding polypeptides having DmaW activity disclosed herein. Usually the set of PCR-primers used in these methods consist of two PCR-primer, each comprise at least 15, 16, 17, 18, 19, 20, 21, 22, 23, 24, 28, but less than 100, 90, 80, 70, 60, 50, 40 or 30 consecutive nucleotides of sequence encoding a polypeptide having DmaW activity and being disclosed herein. Preferably the PCR-primers will bind without any nucleotide mismatches to the sequence of the polynucleotides to be amplified. The same methods will in also apply for the amplification of polynucleotides encoding polypeptides having EasF, EasE, EasC, EasD, EasH, EasA and EasG activity, using the sequence information provided herein for polypeptides having the respective activity.

Preferably, at least one of the polypeptides having DmaW activity is selected from the sequences listed in Table 2, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

TABLE 2

%-identity table of exemplary polypeptides having DmaW activity

| SEQ ID NO: | 19 | 20 | 21 | 22 | 23 | 24 | 25 | 26 | 27 | 28 |
|---|---|---|---|---|---|---|---|---|---|---|
| *A. japonicus* SEQ ID NO: 19 | | 66% | 67% | 66% | 64% | 62% | 62% | 61% | 58% | 56% |
| *P. divaricatus* SEQ ID NO: 20 | | | 66% | 65% | 65% | 64% | 64% | 65% | 62% | 60% |
| *T. equinum* SEQ ID NO: 21 | | | | 62% | 60% | 58% | 61% | 59% | 57% | 58% |
| *A. fumigatus* SEQ ID NO: 22 | | | | | 63% | 61% | 61% | 62% | 57% | 56% |
| *E. brachyelytri* SEQ ID NO: 23 | | | | | | 67% | 70% | 92% | 66% | 66% |
| *M. robertsii* SEQ ID NO: 24 | | | | | | | 75% | 67% | 68% | 67% |
| *P. ipomoeae* SEQ ID NO: 25 | | | | | | | | 67% | 76% | 75% |
| *N. coenop.* SEQ ID NO: 26 | | | | | | | | | 64% | 65% |
| *B. obtecta* SEQ ID NO: 27 | | | | | | | | | | 69% |

Preferably the polypeptides having DmaW activity comprise at least one of the DmaW signature sequences described below or they comprise the DmaW consensus sequence. Preferably they comprise both of the DmaW signature sequences and even more they comprise both of the DmaW signature sequences and the DmaW consensus sequence. The DmaW signature and consensus sequences describe consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the DmaW sequence alignment of the sequences specified in Table 2 and shown in FIGS. 3a to 3d.

DmaW signature sequence 1 (SEQ ID NO: 124):
IXTQNKLALDLXXXXFXXKXYXYPXLKXXTG

DmaW signature sequence 2 (SEQ ID NO: 125):
RLXSCDLXXPXSRXKIYXXEXXVXLXXXEDLWTXGGXXXDXXTXXGLXXL

RELWXLXXXXXXXXXXYPXXXLXXGXXPXEXLPXMXNXTXXH

-continued

DmaW consensus sequence (SEQ ID NO: 126):
MXXXNXXXXXVYXTLSXXFDFXXXXQXLWWHSTAPMFAXMLQTAXYXXHX

QYXHLGIYKKXXIPFLGVYPTXXXXRWLSILTRYGTPFELSLNCSXSXVR

YTYEPINAATGTXKDPFNTXAIWXSLXXLXXXQXGIDLEWFXYFKXXLTL

XXXESAYLXXNNXLVXXQIKTQNKLALDLKGXXFVLKTYIYPALKSXATG

KSXHELXFGSVXRLSXXXPSIXXPLXXLEXYVXSRGXXXXXXXXXXSTXS

PRLLSCDLXDPXKSRVKIYLLERMVSLXAMEDLWTLGGRRXDXSTLXGLE

MIRELWXLXXLPXGLXXYPXPYLXLGXIPXEQLPLMANYTLHHXDPX-PE

PQVYFTXFGMNDXXXXXALTTFFERRGWXXMAXXYKXXLXXXYPHXDXEX

LNYL-HAYISFSYRXNKPYLSVYLHSFETGDWPXXXXXXXXXFXXXR

DmaW consensus sequence 2 (SEQ ID NO: 190):
MXTXNXSXXEVYXTLSXXFDFPNXDQXLWWHSTAPMFAXMLQTANYXXHX

QYXHLGIYKKHVIPFLGVYPTXXKXRWLSILTRYGTPFELSLNCSXSXVR

YTYEPINAATGTXKDPFNTXAIWXSLQXLXXXQXGIDLEWFXYFKXELTL

XXXESAYLXXNNXLVXXQIKTQNKLALDLKGXXFVLKTYIYPALKSXATG

KSIHELXFGSVXRLSXXXPSIRXPLXXLEXYVXSRNXXXXXXXXXXXLS

PRLLSCDLXDPXKSRVKIYLLERMVSLXAMEDLWTLGGRRXDXSTXXGLX

MIRELWXLLXXPXGLXXYPXPYLPLGXIPXEQLPSMANYTLHHXDPX-PE

PQVYFTVFGMNDMXVXDALTTFFERRGWXXMAXKYKAXLXXSYPHXDHEX

LNYL-HAYISFSYRXNKPYLSVYLHSFETGDW

Preferably the DmaW activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:
a) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 19,
b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 19 and having at least 85%, preferably at least 89%, sequence identity to SEQ ID NO: 190, even more preferred having all amino acids which are 100% conserved in the alignment as shown in FIG. 3,
c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 180,
d) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 180, and having at least 85%, preferably at least 89%, sequence identity to SEQ ID NO: 190, even more preferred having all amino acids which are 100% conserved in the alignment as shown in FIG. 3, and
e) a polypeptide according to at least one of a) to d) which is obtainable from a natural ergot alkaloid producer organism.

The EasF activity of any one of the recombinant microorganism or recombinant natural ergot alkaloid producer organism or recombinant polynucleotides as described for this invention is preferably due to the activity of at least one polypeptide or at least one polynucleotide coding for at least one polypeptide selected from the group of:
a) a polypeptide comprising an amino acid sequence having at least 90%, 91%, 92%, 93%, 94%, 95%, 96%, 97%, 98%, 99%, or 100% sequence identity to SEQ ID NO: 154,
b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75 and/or 76, or
c) a polypeptide comprising an amino acid sequence having at least 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85,
d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 107 and/or 120,
e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 134 and/or 142,
f) a polypeptide encoded by a polynucleotide obtainable with two PCR-Primers, each comprising at least 15 consecutive nucleotides of a polynucleotide sequence selected from the group of sequences described by SEQ ID NO: 107, 120 134 and/or 142, or
g) a polypeptide encoded by a polynucleotide which hybridizes under stringent conditions to SEQ ID NO: 107, 120 134 and/or 142,
h) a polypeptide according to at least two of a) to g), preferably according to at least a) and b) and
i) a polypeptide according to at least one of a) to h) which is obtainable from a natural ergot alkaloid producer organism.

A polynucleotide encoding a polypeptide having EasF activity can, in principle, be obtained from any of the natural ergot alkaloid producers mentioned herein. In one embodiment, the polynucleotide is obtained from a natural ergot alkaloid producer selected from the group consisting of:
*Aspergillus terreus, Balansia andropogonis, Balansia cyperi, Balansia obtecta, Balansia pilulaeformis, Claviceps Africana, Claviceps fusiformis, Claviceps hirtella, Sphacelia eriochloae, Sphacelia texensis, Sphacelia lovelessii, Neotyphodium* sp. Lp1, *Neotyphodium coenophialum, Neotyphodium lolii, Penicillium citrinum, Penicillium commune, Penicillium corylophillum, Penicillium crustosum, Penicillium fellutanum* and *Penicillium palitans*,
or is consisting of: *Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicil-*

*lium fellutanum, Penicillium waksmanii, Penicillium roqueforti* and *Paecilomyces divaricatus,* or is consisting of: *Arthroderma benthamiae, Arthroderma gypseum, Arthroderma otae, Epichloe brachyelytri, Epichloe festucae, Epichloe glyceriae, Epichloe typhina, Malbranchea aurantiaca, Microsporum canis, Metarhizium acridum, Metarhizium robertsii, Periglandula ipomoeae, Trichophyton equinum, Trichophyton rubrum, Trichophyton tonsurans,* and *Trichophyton verrucosum.* or is consisting of: *Aspergillus japonicus, Aspergillus fumigatus, Claviceps purpurea,* and *Paecilomyces divaricatus.* or is consisting of a group being a combination of any one of these groups.

Preferably, at least one of the polypeptides having EasF activity is selected from the sequences listed in Table 3, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

Figure 4A:
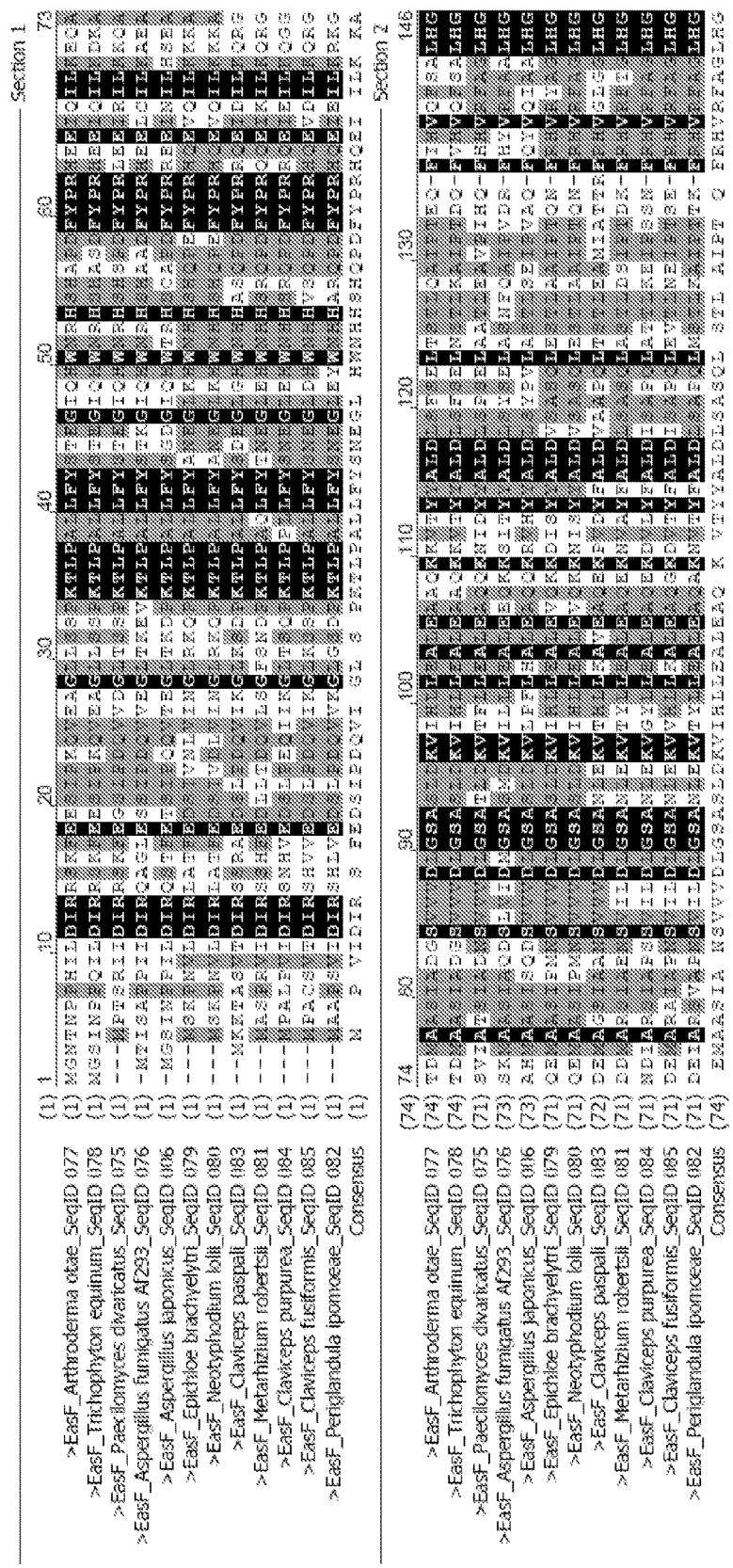
Figure 4B:
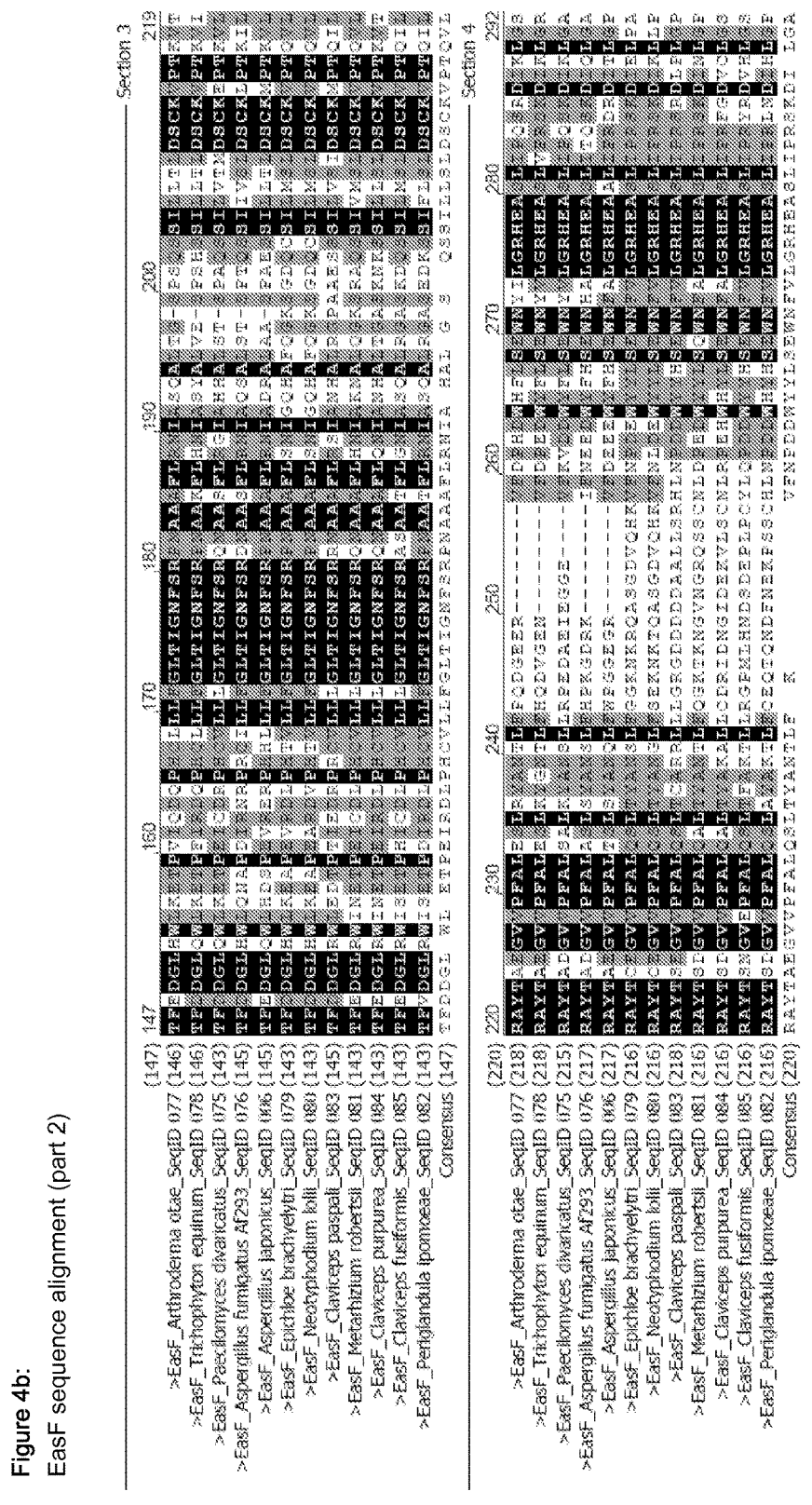
Figure 4C:
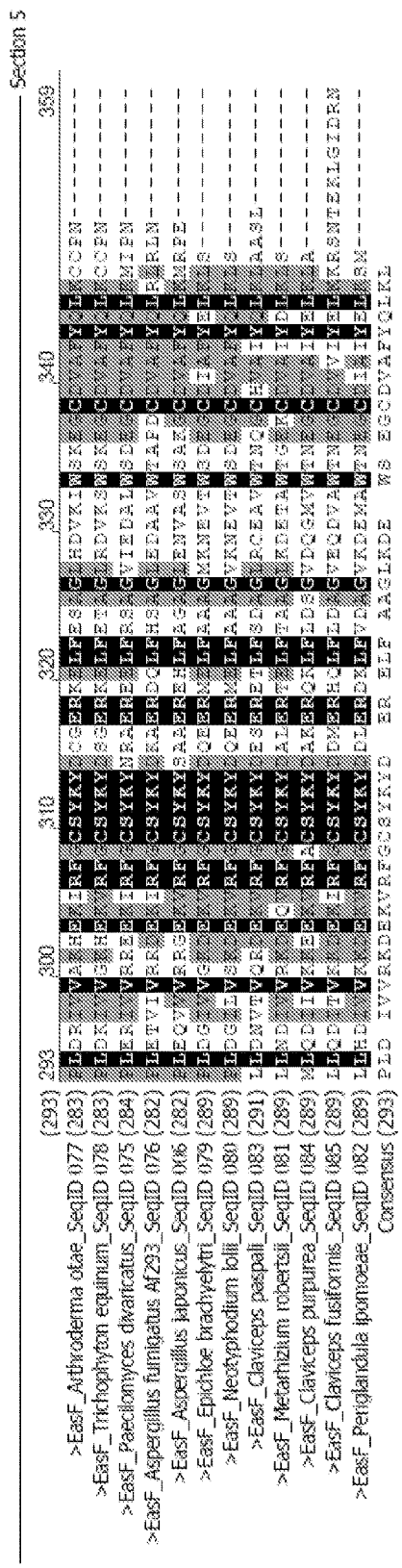
Figure 5A:
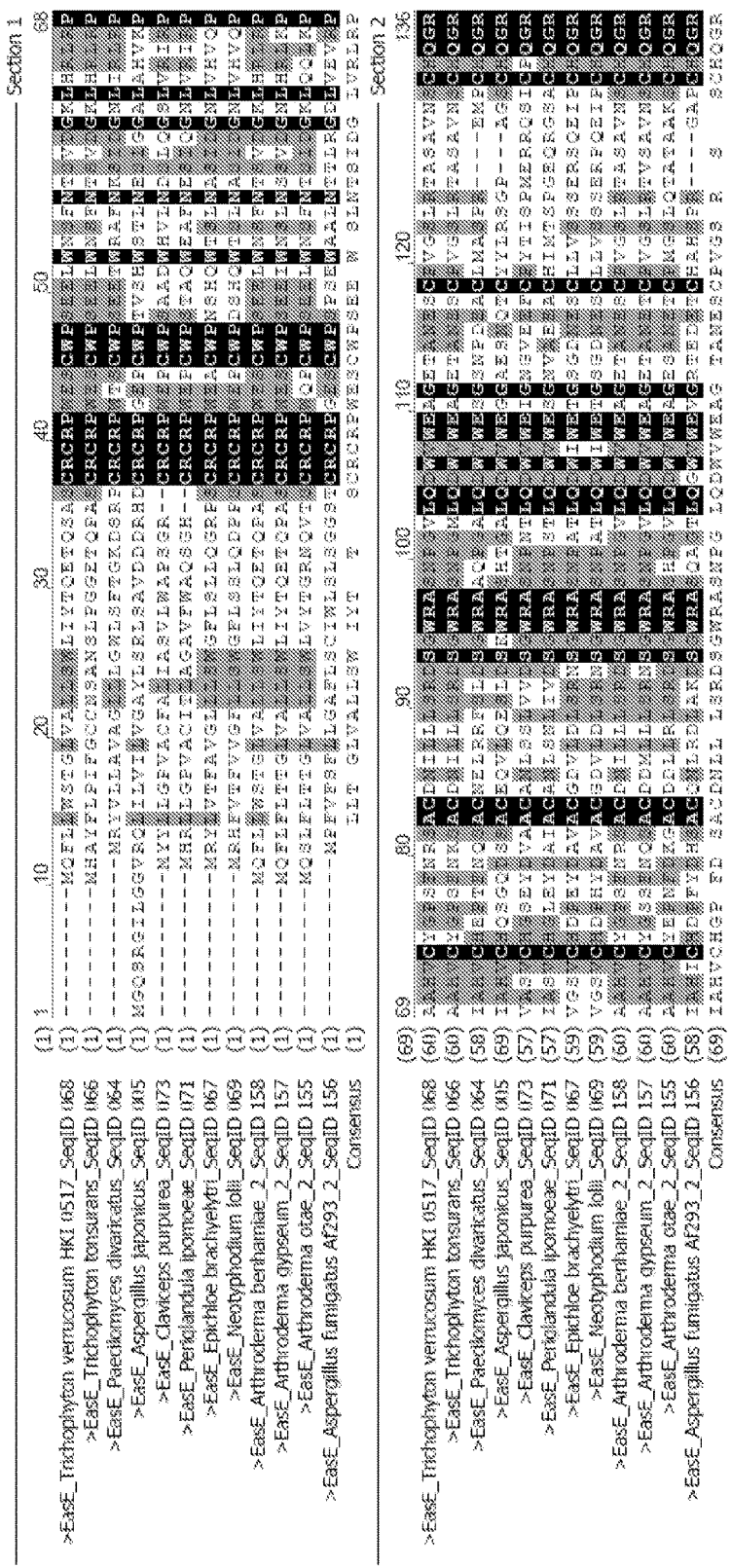
Figure 5C:
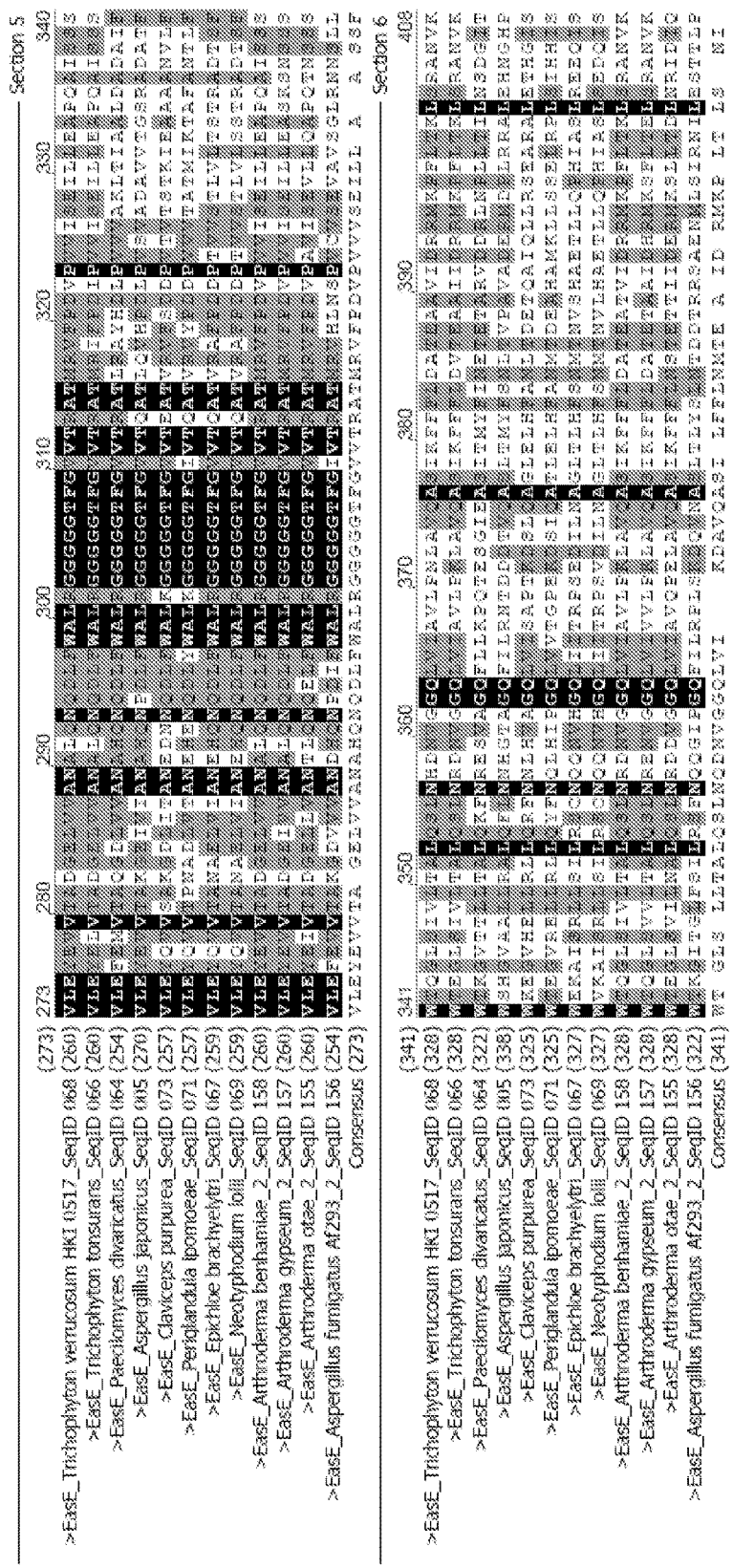
Figure 5D:
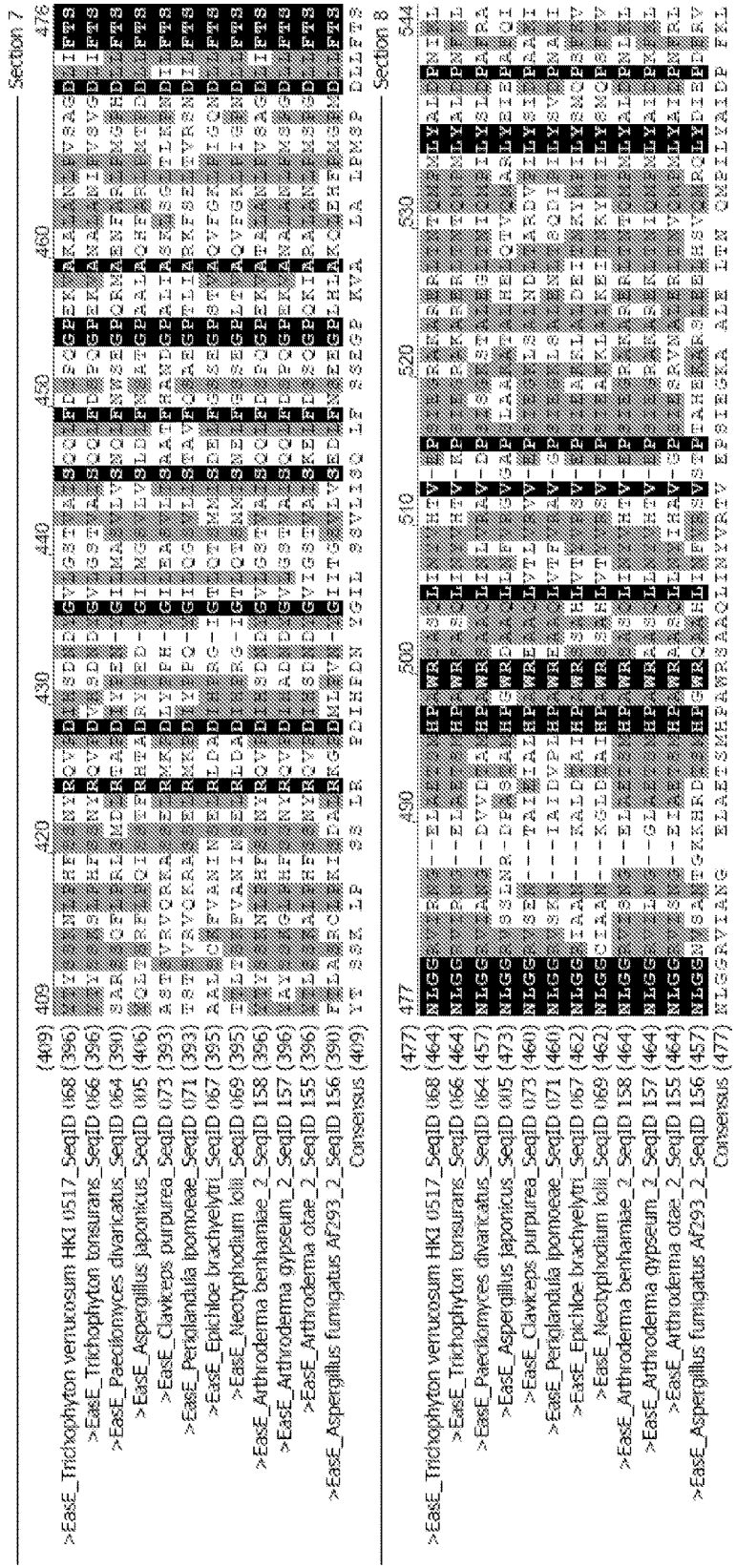
Figure 6A:
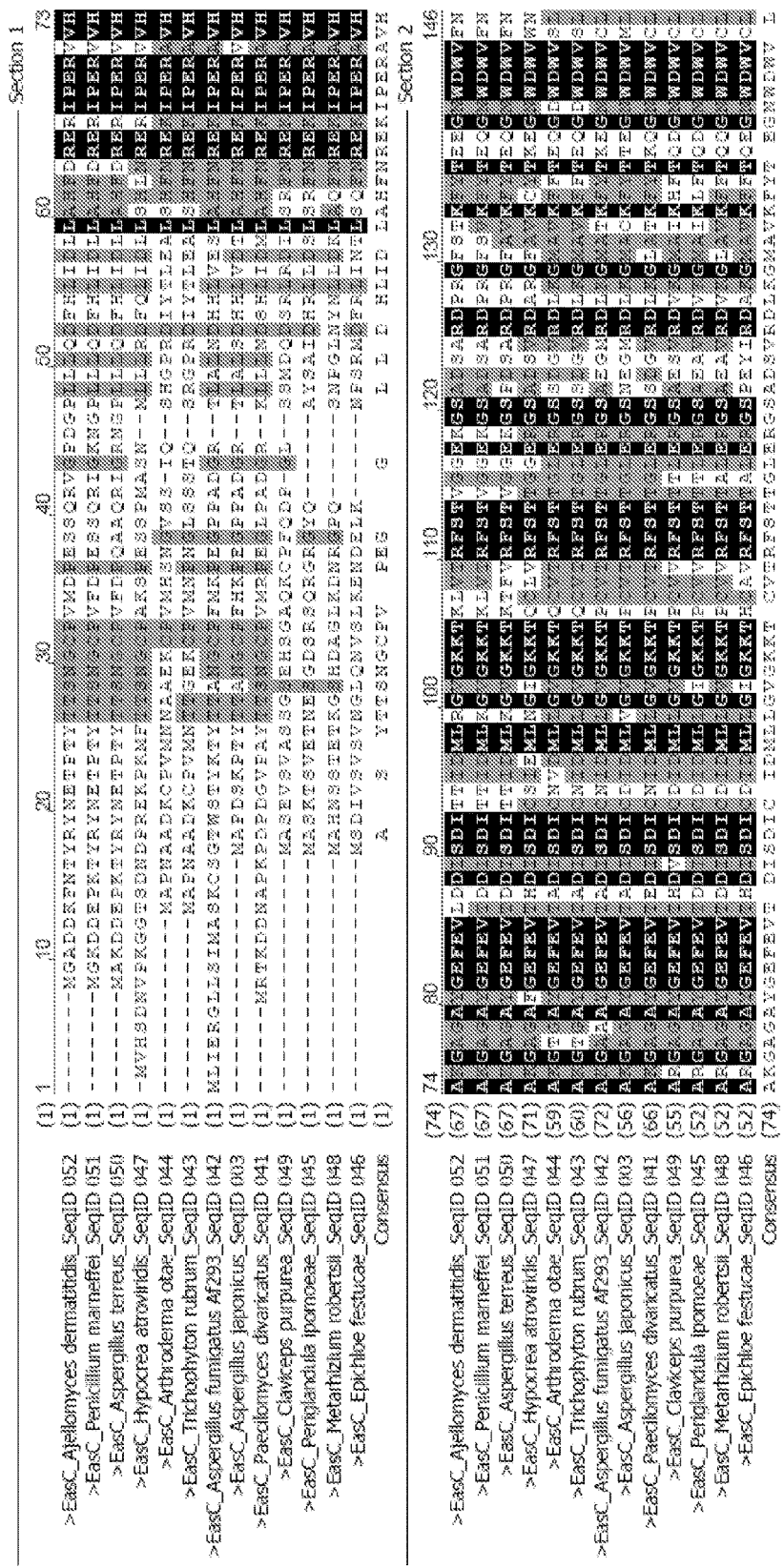
Figure 6C:
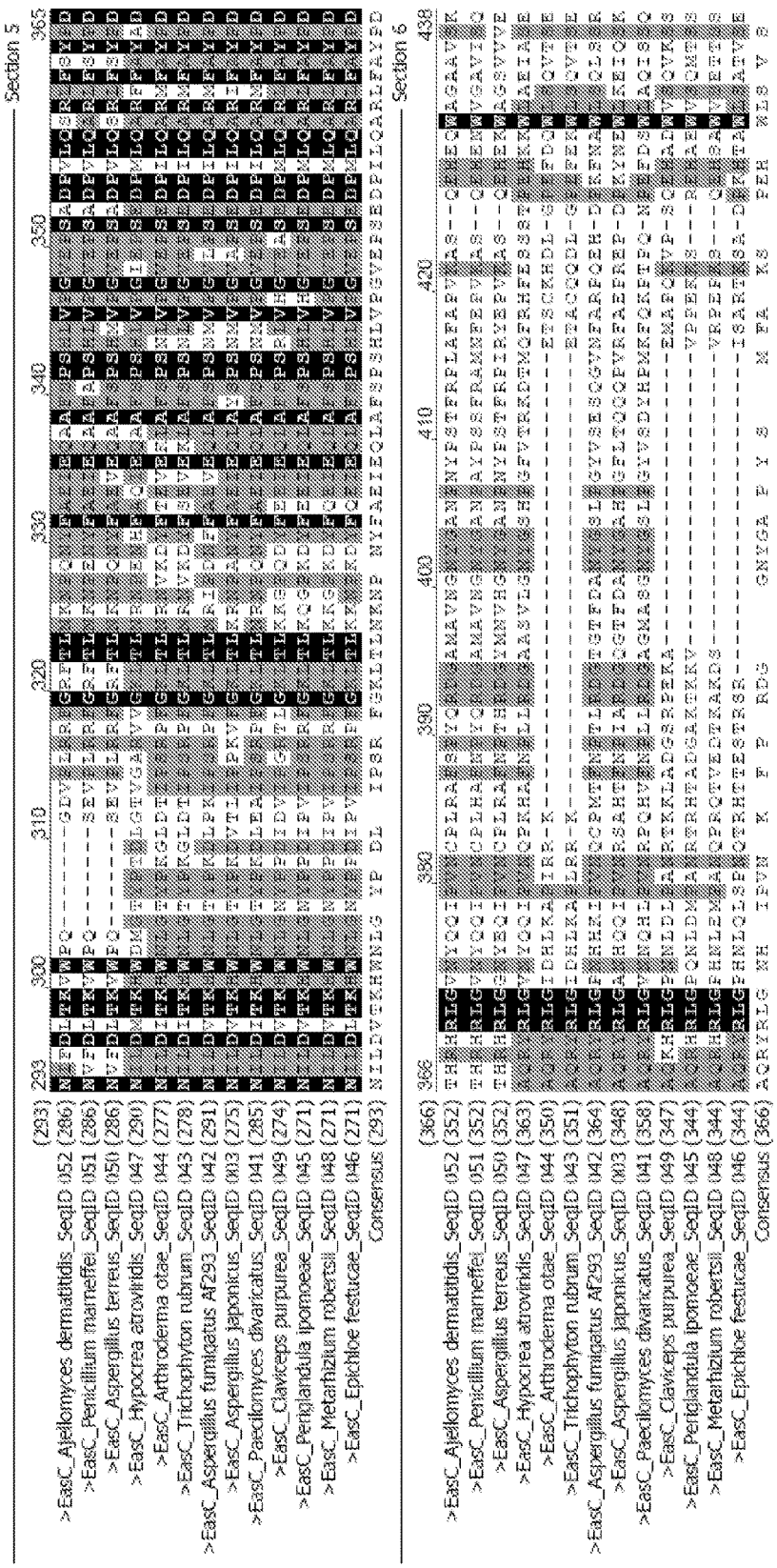

Preferably the polypeptides having EasF activity comprise the EasF consensus sequence. The EasF consensus sequence describes consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the EasF sequence alignment of the sequences specified in Table 3 and shown in FIGS. 4a to 4c.

EasF consensus sequence (SEQ ID NO: 154):
MXXPXVIDIRXSXFEDSIPDQVIXGLXSXPKTLPALLFYSNEGLXHWNHH
SHQPDFYPRHQEIXILKXKAXEMAASIAXNSVVVDLGSASLDKVIHLLEA
LEAQXKXVTYYALDLSASQLXSTLXAIPTXQXFRHVRFAGLHGTFDDGLX
WLXETPEIRDLPHCVLLFGLTIGNFSRPNAAAFLRNIAXHALXGXSXXQS

TABLE 3

%-identity table of exemplary polypeptides having EasF activity

| SEQ ID NO: | 75 | 76 | 77 | 78 | 79 | 80 | 82 | 81 | 83 | 84 | 85 |
|---|---|---|---|---|---|---|---|---|---|---|---|
| *Aspergillus japonicus* SEQ ID NO: 6 | 65% | 67% | 68% | 67% | 61% | 61% | 56% | 58% | 57% | 56% | 53% |
| *Paecilomyces divaricatus* SEQ ID NO: 75 | | 67% | 72% | 71% | 63% | 64% | 60% | 62% | 60% | 60% | 59% |
| *Aspergillus fumigatus* SEQ ID NO: 76 | | | 65% | 64% | 61% | 61% | 58% | 57% | 55% | 54% | 54% |
| *Arthroderma otae* SEQ ID NO: 77 | | | | 88% | 66% | 66% | 63% | 62% | 58% | 60% | 60% |
| *Trichophyton equinum* SEQ ID NO: 78 | | | | | 66% | 66% | 62% | 62% | 57% | 58% | 58% |
| *Epichloe brachyelytri* SEQ ID NO: 79 | | | | | | 95% | 64% | 66% | 60% | 61% | 63% |
| *Neotyphodium lolii* SEQ ID NO: 80 | | | | | | | 64% | 66% | 60% | 60% | 62% |
| *Periglandula ipomoeae* SEQ ID NO: 82 | | | | | | | | 74% | 68% | 74% | 76% |
| *Metarhizium robertsii* SEQ ID NO: 81 | | | | | | | | | 64% | 72% | 69% |
| *Claviceps paspali* SEQ ID NO: 83 | | | | | | | | | | 65% | 68% |
| *Claviceps purpurea* SEQ ID NO: 84 | | | | | | | | | | | 73% |
| *Claviceps fusiformis* SEQ ID NO: 85 | | | | | | | | | | | |

-continued

```
SILLSLDSCKVPTQVLRAYTAEGVVPFALQSLTYANTLFXXKXXXXXXXX

XXXXVFNPDDWYYLSEWNFVLGRHEASLIPRSKDIXLGAPLDXIVVRKDE

KVRFGCSYKYDXXERXELFXAAGLKDEXXWSXEGCDVAFYQLKL
```

Preferably the EasF activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:

a) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6 and having at least 75%, preferably at least 79%, sequence identity to SEQ ID NO: 154, even more preferred having all amino acids which are 100% conserved in the alignment as shown in FIG. 4, c) polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 75, d) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6 and having at least 75%, preferably at least 83%, sequence identity to SEQ ID NO: 154, even more preferred having all amino acids which are 100% conserved in the alignment as shown in FIG. 4, e) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 76, f) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 76 and having at least 75%, preferably at least 78%, sequence identity to SEQ ID NO: 154, even more preferred having all amino acids which are 100% conserved in the alignment as shown in FIG. 4, and g) a polypeptide according to at least one of a) to f) which is obtainable from a natural ergot alkaloid producer organism.

The EasE activity of any one of the recombinant microorganism or recombinant natural ergot alkaloid producer organism or recombinant polynucleotides as described for this invention is preferably due to the activity of at least one polypeptide or at least one polynucleotide selected from the group of:

a) a polypeptide comprising an amino acid sequence having at least 90%, 91%, 92%, 93%, 94%, 95%, 96%, 97%, 98%, 99%, or 100% sequence identity to SEQ ID NO: 153, 185 and/or 191, preferably having at least 90%, 91%, 92%, 93%, 94%, 95%, 96%, 97%, 98%, 99%, or 100% sequence identity to SEQ ID NO: 191, b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5 and/or 64, c) a polypeptide comprising an amino acid sequence having at least 90%, 91%, 92%, 93%, 94%, 95%, 96%, 97%, 98%, 99%, or 100% sequence identity to SEQ ID NO: 5, 64, 65, 66, 67, 68, 69, 70, 71, 72, 73 and/or 74 or having at least 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178, d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 106, e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 133 and/or 141, f) a polypeptide encoded by a polynucleotide obtainable with two PCR-Primers, each comprising at least 15 consecutive nucleotides of a polynucleotide sequence selected from the group of sequences described by SEQ ID NO: 106, 133 and/or 141, g) a polypeptide encoded by a polynucleotide which hybridizes under stringent conditions to SEQ ID NO: 106, 133 and/or 141, h) a polypeptide according to at least two of a) to g), preferably according to at least a) and b) and i) a polypeptide according to at least one of a) to h) which is obtainable from a natural ergot alkaloid producer organism.

Preferably the encoded polypeptide has an N-terminal sequence, which can function as sorting signal to the endoplasmatic reticulum.

A polynucleotide encoding a polypeptide having EasE activity can, in principle, be obtained from any of the natural ergot alkaloid producers mentioned herein. In one embodiment, the polynucleotide is obtained from a natural ergot alkaloid producer selected from the group consisting of:

*Aspergillus terreus, Balansia andropogonis, Balansia cyperi, Balansia obtecta, Balansia pilulaeformis, Claviceps Africana, Claviceps fusiformis, Claviceps hirtella, Sphacelia eriochloae, Sphacelia texensis, Sphacelia lovelessii, Neotyphodium sp. Lp1, Neotyphodium coenophialum, Neotyphodium lolii, Penicillium citrinum, Penicillium commune, Penicillium corylophillum, Penicillium crustosum, Penicillium fellutanum* and *Penicillium palitans,* or is consisting of: *Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicillium fellutanum, Penicillium waksmanii, Penicillium roqueforti* and *Paecilomyces divaricatus,* or is consisting of: *Arthroderma benthamiae, Arthroderma gypseum, Arthroderma otae, Epichloe brachyelytri, Epichloe festucae, Epichloe glyceriae, Epichloe typhina, Malbranchea aurantiaca, Microsporum canis, Metarhizium acridum, Metarhizium robertsii, Periglandula ipomoeae, Trichophyton equinum, Trichophyton rubrum, Trichophyton tonsurans,* and *Trichophyton verrucosum,* or is consisting of: *Aspergillus japonicus, Aspergillus fumigatus, Claviceps purpurea,* and *Paecilomyces divaricatus.* or is consisting of a group being a combination of any one of these groups.

Preferably, at least one of the polypeptides having EasE activity is selected from the sequences listed in Table 4, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

TABLE 4

%-identity table of exemplary polypeptides having EasE activity

| SEQ ID NO: | 64 | 175 | 66 | 67 | 68 | 69 | 176 | 71 | 177 | 73 | 178 |
|---|---|---|---|---|---|---|---|---|---|---|---|
| *Aspergillus japonicus* SEQ ID NO: 5 | 56% | 53% | 46% | 48% | 46% | 48% | 54% | 46% | 52% | 48% | 49% |
| *Paecilomyces divaricatus* SEQ ID NO: 64 | | 56% | 54% | 50% | 54% | 50% | 54% | 50% | 57% | 48% | 57% |
| *Arthroderma otae* SEQ ID NO: 175 | | | 76% | 48% | 78% | 48% | 51% | 48% | 79% | 48% | 79% |
| *Trichophyton tonsurans* SEQ ID NO: 66 | | | | 47% | 90% | 47% | 49% | 47% | 83% | 47% | 5% |
| *Epichloe brachyelytri* SEQ ID NO: 67 | | | | | 47% | 94% | 49% | 55% | 50% | 52% | 50% |
| *Trichophyton verrucosum* SEQ ID NO: 68 | | | | | | 47% | 49% | 46% | 85% | 46% | 97% |
| *Neotyphodium lolii* SEQ ID NO: 69 | | | | | | | 50% | 54% | 49% | 50% | 49% |
| *Aspergillus fumigatus* SEQ ID NO: 176 | | | | | | | | 51% | 50% | 49% | 50% |
| *Periglandula ipomoeae* SEQ ID NO: 71 | | | | | | | | | 49% | 73% | 48% |
| *Arthroderma gypseum* SEQ ID NO: 177 | | | | | | | | | | 49% | 87% |
| *Claviceps purpurea* SEQ ID NO: 73 | | | | | | | | | | | 48% |
| *Arthroderma benhamiae* SEQ ID NO: 178 | | | | | | | | | | | |

Preferably the polypeptides having EasE activity comprise the EasE consensus sequence. The EasF consensus sequence describes consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the EasE sequence alignment of the sequences specified in Table 4 and shown in FIGS. 5*a* to 5*e*.

```
EasE consensus sequence (SEQ ID NO: 153):
MXXLVXXXXXXXLXXXLXXXXXXXXXCRCRPWEXCWPSXXXWXSXNXSID

GXLXXLRPI-AXVCHXPXFDXSACXXLLXLSRDSGWRASNPGXLQDWVWE

AGXTANESCPVGSXRXXSXXXSCHQGRIPLYSAAVESTXQVQXAVRFARR

HNLRLVIRNTGHDXAGRSSAPDSFQIHTHRLQEIXFHXNFRLXGSXXXXT

SLGXPAVTVGAGVMMGELYAXGARXGYMVLGGECPTVGVVGGFLQGGGVS

SFLSFXXGLAVDNVLEYEVVTAXGELVVANAHQNQDLFWALRGGGGGTFG

VVTRATMRVFPDVPVVVSEILLXAXXAXSS-FWTXGLSXLLTALQSLNQD

NVGGQLVIXXXXKDAVQASIXLFFLNMTEXAXIDXRMKPXLTXLSXXNIX

YTXSSKXLPXXSSXLRXXPDIHPDNXYGILXSSVLISQXLFXSSE-GPXK

VAXXLAXLPMSPXDLLFTSNLGGRVIANGXXELAETSMHPAWRSAAQLIN

YVRTVXEPSIEGKAXALEXLTNXQMPILYAIDPXFKLSYRNLGDPNEKDF

QQVYWGXNX-YGRLSXIKKKWDPDDLFFSKLGVGSEXWDSEGMCRKXXXX

QXXLXQXLXXLXS

EasE consensus sequence 2 (SEQ ID NO: 153):
LLTXGLVALLSWXIYTXXTXXXSCRCRPWESCWPSEEXWXSLNTSIDGXL

VRLRPIAHVCHGPXFDXSACDNLLXLSRDSGWRASNPGXLQDWVWEAGXT
```

-continued

```
ANESCPVGSXRXXSXXXSCHQGRIPLYSAAVESTXQVQXAVRFARRHNLR

LVIRNTGHDXAGRSSAPDSFQIHTHRLQEIXFHXNFRLXGSXXXXTSLGX

PAVTVGAGVMMGELYAXGARXGYMVLGGECPTVGVVGGFLQGGGVSSFLS

FXXGLAVDNVLEYEVVTAXGELVVANAHQNQDLFWALRGGGGGTFGVVTR

ATMRVFPDVPVVVSEILLXAXXAXSSFWTXGLSXLLTALQSLNQDNVGGQ

LVIXXXXKDAVQASIXLFFLNMTEXAXIDXRMKPXLTXLSXXNIXYTXSS

KXLPXXSSXLRXXPDIHPDNXYGILXSSVLISQXLFXSSEGPXKVAXXLA

XLPMSPXDLLFTSNLGGRVIANGXXE-LAETSMHPAWRSAAQLINYVRTV

XEPSIEGKAXALEXLTNXQMPILYAIDPXFKLSYRNLGDPNEKDFQQVYW

GXNXYGRLSXIKKKWDPDDLFFSKLGVGSEXWDSEGMCRKXXXXQXXLXQ

XLXXLXS

EasE core consensus sequence (SEQ ID NO: 191):
CRCRPWESCWPSEEXWXSLNTSIDGXLVRLRPIAHVCHGPXFDXSACDNL

LXLSRDSGWRASNPGXLQDWVWEAGXTANESCPVGSXRXXXXXXSCHQGR

IPLYSAAVESTXQVQXAVRFARRHNLRLVIRNTGHDXAGRSSAPDSFQIH

THRLQEIXFHXNFRLXGSXXXXTSLGXPAVTVGAGVMMGELYAXGARXGY

MVLGGECPTVGVVGGFLQGGGVSSFLSFXXGLAVDNVLEYEVVTAXGELV

VANAHQNQDLFWALRGGGGGTFGVVTRATMRVFPDVPVVVSEILLXAXXA

XSSFWTXGLSXLLTALQSLNQDNVGGQLVIXXXXKDAVQASIXLFFLNMT

EXAXIDXRMKPXLTXLSXXNIXYTXSSKXLPXXSSXLRXXPDIHPDNXYG

ILXSSVLISQXLFXSSEGPXKVAXXLAXLPMSPXDLLFTSNLGGRVIANG

XXELAETSMHPAWRSAAQLINYVRTVXEPSIEGKAXALEXLTNXQMPILY

AIDPXFKLSYRNLGDPNEKDFQQVYWGXNXYGRLSXIKKKWDPDDLFFSK

LGVGSEXWDSEGMCRK
```

Preferably the EasE activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:

a) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5 and having at least 70%, preferably at least 73%, sequence identity to SEQ ID NO: 191, even more preferred having all amino acids which are 100% conserved in the alignment as shown in FIG. 5, c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 64, d) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 64, and having at least 75%, preferably at least 79%, sequence identity to SEQ ID NO: 191, even more preferred having all amino acids which are 100% conserved in the alignment as shown in FIG. 5, and e) a polypeptide according to at least one of a) to d) which is obtainable from a natural ergot alkaloid producer organism.

The EasC activity of any one of the recombinant microorganism or recombinant natural ergot alkaloid producer organism or recombinant polynucleotides as described for this invention is preferably due to the activity of at least one polypeptide or at least one polynucleotide selected from the group of:

a) a polypeptide comprising an amino acid sequence having at least 90%, 91%, 92%, 93%, 94%, 95%, 96%, 97%, 98%, 99%, or 100% sequence identity to SEQ ID NO: 151 and/or 192, or, b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 and/or 41, or c) a polypeptide comprising an amino acid sequence having at least 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52, or d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 104, or e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 131 or 139, or, f) a polypeptide encoded by a polynucleotide obtainable with two PCR-Primers, each comprising at least 15 consecutive nucleotides of a polynucleotide sequence selected from the group of sequences described by SEQ ID NO: 104, 131 and/or 139, or g) a polypeptide encoded by a polynucleotide which hybridizes under stringent conditions to SEQ ID NO: 104, 131 and/or 139 or h) a polypeptide according to at least two of a) to g), preferably according to at least a) and b and i) a polypeptide according to at least one of a) to h) which is obtainable from a natural ergot alkaloid producer organism.

A polynucleotide encoding a polypeptide having EasC activity can, in principle, be obtained from any of the natural ergot alkaloid producers mentioned herein. In one embodiment, the polynucleotide is obtained from a natural ergot alkaloid producer selected from the group consisting of: *Aspergillus terreus, Balansia andropogonis, Balansia cyperi, Balansia obtecta, Balansia pilulaeformis, Claviceps Africana, Claviceps fusiformis, Claviceps hirtella, Sphacelia eriochloae, Sphacelia texensis, Sphacelia lovelessii, Neotyphodium* sp. Lp1, *Neotyphodium coenophialum, Neotyphodium lolii, Penicillium citrinum, Penicillium commune, Penicillium corylophillum, Penicillium crustosum, Penicillium fellutanum* and *Penicillium palitans*, or is consisting of: *Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicillium fellutanum, Penicillium waksmanii, Penicillium roqueforti* and *Paecilomyces divaricatus*, or is consisting of: *Arthroderma benthamiae, Arthroderma gypseum, Arthroderma otae, Epichloe brachyelytri, Epichloe festucae, Epichloe glyceriae, Epichloe typhina, Metarhizium acridum, Metarhizium robertsii, Periglandula ipomoeae, Trichophyton equinum, Trichophyton rubrum* and *Trichophyton verrucosum*, or is consisting of: *Aspergillus japonicus, Aspergillus fumigatus, Claviceps purpurea,* and *Paecilomyces divaricatus.* or is consisting of a group being a combination of any one of these groups.

Preferably, at least one of the polypeptides having EasC activity is selected from the sequences listed in Table 5, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

TABLE 5

%-identity table of exemplary polypeptides having EasC activity

| SEQ ID NO: | 41 | 42 | 43 | 44 | 45 | 46 | 47 | 48 | 49 | 50 | 51 | 52 |
|---|---|---|---|---|---|---|---|---|---|---|---|---|
| *Aspergillus japonicus* SEQ ID NO: 3 | 72% | 76% | 63% | 62% | 58% | 58% | 54% | 59% | 57% | 48% | 48% | 48% |
| *Paecilomyces divaricatus* SEQ ID NO: 41 | | 73% | 68% | 66% | 58% | 59% | 54% | 60% | 58% | 49% | 50% | 50% |
| *Aspergillus fumigatus* SEQ ID NO: 42 | | | 65% | 64% | 58% | 61% | 51% | 59% | 56% | 45% | 45% | 46% |
| *Trichophyton rubrum* SEQ ID NO: 43 | | | | 92% | 58% | 59% | 51% | 58% | 57% | 45% | 44% | 44% |
| *Arthroderma otae* SEQ ID NO: 44 | | | | | 60% | 59% | 50% | 58% | 58% | 43% | 42% | 43% |
| *Periglandula ipomoeae* SEQ ID NO: 45 | | | | | | 74% | 47% | 79% | 79% | 42% | 43% | 42% |
| *Epichloe festucae* SEQ ID NO: 46 | | | | | | | 49% | 74% | 70% | 43% | 42% | 43% |
| *Hypocrea atroviridis* SEQ ID NO: 47 | | | | | | | | 47% | 47% | 48% | 50% | 48% |
| *Metarhizium robertsii* SEQ ID NO:48 | | | | | | | | | 73% | 45% | 45% | 45% |
| *Claviceps purpurea* SEQ ID NO: 49 | | | | | | | | | | 42% | 43% | 44% |
| *Aspergillus terreus* SEQ ID NO: 50 | | | | | | | | | | | 85% | 84% |
| *Penicillium marneffei* SEQ ID NO: 51 | | | | | | | | | | | | 86% |
| *Ajellomyces dermatitidis* SEQ ID NO: 52 | | | | | | | | | | | | |

Preferably the polypeptides having EasC activity comprise the EasC consensus sequence. The EasF consensus sequence describes consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the EasC sequence alignment of the sequences specified in Table 5 and shown in FIGS. 6a to 6d.

```
EasC consensus sequence (SEQ ID NO: 151):
AXXXSXXYTTSNGCPVXXPEGXXXXGXXXXLXLXDXHLIDXLAHFNREKI

PERAVHAKGAGAYGEFEVTXDISDICXIDMLLGVGKKTXCVTRFSTTGLE

RGSADSVRDLKGMAV-KFYTXEGNWDWVXLNXPMFFIRDPSKFPXLIHAQ

RRDPQTNLXNPSMFWDFVTXN-HEALHMVMXQFSDFGTMFXYRSMSGYVG

HAYKWVMPDGSFKYVHIFLSSDQGPNFXXGXXAXXIAXXDPDXATRDLYE

AIERGEYPSWTANVQVVDPEDAXKLGFNILDVTKHWNLGXYPXDLXXIPS

RXFGKLTLNKNPXNYFAEIEQLAFSPSHLVPGVEPSEDPILQARLFAY-P

DAQRYRLGXNHXXIPVNXXKXXFXPXXRDGXXXXXGNYGAXPXYXSXXXX

MXFAXXKSXXXPEHXXWLSXVXSXSWXXXXEXDYK-FAREFWXXLPXXRX

QEFQDXMVXNMAXSVAQXXXELRKKVYXTFXLVAXDLAXRVKXG-TEXLV

A

EasC consensus core sequence (SEQ ID NO: 192):
LAHFNREKIPERAVHAKGAGAYGEFEVTXDISDICXIDMLLGVGKKTXCV

TRFSTTGLERGSADSVRDLKGMAVKFYTXEGNWDWVXLNXPMFFIRDPSK

FPXLIHAQRRDPQTNLXNPSMFWDFVTXNHEALHMVMXQFSDFGTMFXYR

SMSGYVGHAYKWVMPDGS-FKYVHIFLSSDQGPNFXXXXXXXXXXXDPD

XATRDLYEAIERGEYPSWTANVQVVDPEDAXKLGFNILDVTKHWNLGXYP

XDLXXIPSRXFGKLTLNKNPXNYFAEIEQLAFSPSHLVPGVEPSEDPILQ

ARLFAYPDAQRYRLG
```

Preferably the EasC activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:
a) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3,
b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 and having at least 85%, preferably at least 87%, sequence identity to SEQ ID NO: 192, even more preferred having all amino acids which are 100% conserved in the alignment as shown in FIG. 6,
c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 41,
d) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 41, and having at least 85%, preferably at least 90%, sequence identity to SEQ ID NO: 192, even more preferred having all amino acids which are 100% conserved in the alignment as shown in FIG. 6, and
e) a polypeptide according to at least one of a) to d) which is obtainable from a natural ergot alkaloid producer organism.

The EasD activity of any one of the recombinant microorganism or recombinant natural ergot alkaloid producer organism or recombinant polynucleotides as described for this invention is preferably due to the activity of at least one polypeptide or at least one polynucleotide selected from the group of:
a) a polypeptide comprising an amino acid sequence having at least 90%, 91%, 92%, 93%, 94%, 95%, 96%, 97%, 98%, 99%, or 100% sequence identity to SEQ ID NO: 152, or,
b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4 and/or 53, or
c) a polypeptide comprising an amino acid sequence having at least 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63, or
d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 105, or
e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 132 and/or 140, or
f) a polypeptide encoded by a polynucleotide obtainable with two PCR-Primers, each comprising at least 15 consecutive nucleotides of a polynucleotide sequence selected from the group of sequences described by SEQ ID NO: 105, 132 and/or 140,
g) a polypeptide encoded by a polynucleotide which hybridizes under stringent conditions to SEQ ID NO: 105, 132 and/or 140, or
h) a polypeptide according to at least two of a) to g), preferably according to at least a) and b) and
i) a polypeptide according to at least one of a) to h) which is obtainable from a natural ergot alkaloid producer organism.

A polynucleotide encoding a polypeptide having EasD activity can, in principle, be obtained from any of the natural ergot alkaloid producers mentioned herein. In one embodiment, the polynucleotide is obtained from a natural ergot alkaloid producer selected from the group consisting of: *Aspergillus terreus, Balansia andropogonis, Balansia cyperi, Balansia obtecta, Balansia pilulaeformis, Claviceps Africana, Claviceps fusiformis, Claviceps hirtella, Sphace-* lia eriochloae, Sphacelia texensis, Sphacelia lovelessii, Neotyphodium sp. Lp1, Neotyphodium coenophialum, Neotyphodium lolii, Penicillium citrinum, Penicillium commune, Penicillium corylophillum, Penicillium crustosum, Penicillium fellutanum and Penicillium palitans, or is consisting of: Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicillium fellutanum, Penicillium waksmanii, Penicillium roqueforti and Paecilomyces divaricatus, or is consisting of: Arthroderma benthamiae, Arthroderma gypseum, Arthroderma otae, Epichloe brachyelytri, Epichloe festucae, Epichloe glyceriae, Epichloe typhina, Microsporum canis, Metarhizium acridum, Metarhizium robertsii, Periglandula ipomoeae, Trichophyton equinum, Trichophyton rubrum, Trichophyton tonsurans, Trichophyton verrucosum and Trichoderma virens, or is consisting of: Aspergillus japonicus, Aspergillus fumigatus, Claviceps purpurea, and Paecilomyces divaricatus.

or is consisting of a group being a combination of any one of these groups.

Preferably, at least one of the polypeptides having EasD activity is selected from the sequences listed in Table 6, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

Preferably the polypeptides having EasD activity comprise the EasD consensus sequence. The EasD consensus sequence describes consecutive amino acid sequences, wherein each individual amino acid is specified according to the single letter amino acid code used in the art. An amino acid specified with "X" represents any amino acids, preferably it represents an amino acid which is has the same position in at least one of the amino acid sequences of the EasD sequence alignment of the sequences specified in Table 6 and shown in FIGS. 7a and 7b.

```
EasD consensus sequence (SEQ ID NO: 152):
MASVSSKIFAITGGASGIGAATCRLLAXRGAA-VICVGDVSSXNFXSLXK

SIKEINPSTKVHCTVLDVSSSSEVDXWLXDIISTFGDLHGAAN-VAGIAQ

GAGLRQTPTILEEXDXEWXRIFXVNLDGVFYSTRAQVRAMKDLPXXXGXD

R-SIVNVASIAAFSHMPDVYAYGTSKAACAYFTTXCVAADVFPXGIRVNX

VSPGXITNTPLL-PQFXPXAKSLDEVXEXYKKEGFSVIEADDVARTIVWL

LSEDSRPVYGANINVGACMP
```

Preferably the EasD activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:

a) a polypeptide comprising an amino acid sequence having at least 40%, 42%, 44%, 46%, 48%, 50%, 52%, 54%,

TABLE 6

%-identity table of exemplary polypeptides having EasD activity

| SEQ ID NO: | 53 | 54 | 55 | 56 | 57 | 58 | 59 | 60 | 61 | 62 | 63 |
|---|---|---|---|---|---|---|---|---|---|---|---|
| Aspergillus japonicus SEQ ID NO: 4 | 74% | 66% | 64% | 63% | 64% | 64% | 63% | 62% | 61% | 62% | 65% |
| Paecilomyces divaricatus SEQ ID NO: 53 | | 74% | 68% | 68% | 72% | 70% | 68% | 70% | 65% | 65% | 70% |
| Aspergillus fumigatus SEQ ID NO: 54 | | | 70% | 69% | 66% | 68% | 67% | 65% | 66% | 66% | 70% |
| Arthroderma gypseum SEQ ID NO: 55 | | | | 89% | 63% | 65% | 65% | 62% | 81% | 60% | 90% |
| Trichophyton tonsurans SEQ ID NO: 56 | | | | | 64% | 64% | 65% | 63% | 88% | 60% | 965 |
| Epichloe typhnia SEQ ID NO: 57 | | | | | | 72% | 74% | 77% | 59% | 71% | 66% |
| Claviceps purpurea SEQ ID NO: 58 | | | | | | | 85% | 76% | 61% | 80% | 65% |
| Periglandula ipomoeae SEQ ID NO: 59 | | | | | | | | 78% | 62% | 81% | 67% |
| Metarhizium robertsii SEQ ID NO: 60 | | | | | | | | | 58% | 73% | 63% |
| Trichophyton verrucosum SEQ ID NO: 61 | | | | | | | | | | 58% | 89% |
| Claviceps fusiformis SEQ ID NO: 62 | | | | | | | | | | | 62% |
| Arthroderma benhamiae SEQ ID NO: 63 | | | | | | | | | | | |

56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, b) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4 and having at least 80%, preferably at least 81%, sequence identity to SEQ ID NO: 152, even more preferred having all amino acids which are 100% conserved in the alignment as shown in FIG. 7, c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 53, d) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 53, and having at least 85%, preferably at least 86%, sequence identity to SEQ ID NO: 152, even more preferred having all amino acids which are 100% conserved in the alignment as shown in FIG. 7, and e) a polypeptide according to at least one of a) to d) which is obtainable from a natural ergot alkaloid producer organism.

The EasH activity of any one of the recombinant microorganism or recombinant natural ergot alkaloid producer organism or recombinant polynucleotides as described for this invention is preferably due to the activity of at least one polypeptide or at least one polynucleotide selected from the group of:

a) a polypeptide comprising an amino acid sequence having at least 90%, 91%, 92%, 93%, 94%, 95%, 96%, 97%, 98%, 99%, or 100% sequence identity to SEQ ID NO: 156, or b) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95, and having at least 90%, 91%, 92%, 93%, 94%, 95%, 96%, 97%, 98%, 99%, or 100% sequence identity to SEQ ID NO: 156 or c) a polypeptide comprising an amino acid sequence having at least 90%, 91%, 92%, 93%, 94%, 95%, 96%, 97%, 98%, 99%, or 100% sequence identity to SEQ ID NO: 8 and/or 95, or d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 109 and/or 157, or e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 109, 136 or 144 and/or 157, or, f) a polypeptide encoded by a polynucleotide obtainable with two PCR-Primers, each comprising at least 15 consecutive nucleotides of a polynucleotide sequence selected from the group of sequences described by SEQ ID NO: 109, 136, 144 and/or 157, or g) a polypeptide encoded by a polynucleotide which hybridizes under stringent conditions to SEQ ID NO: 109, 136, 144 and/or 157, or h) a polypeptide according to at least two of a) to g), and i) a polypeptide according to at least one of a) to h) which is obtainable from a natural ergot alkaloid producer organism.

A polynucleotide encoding a polypeptide having EasH activity can, in principle, be obtained from any of the natural ergot alkaloid producers mentioned herein. In one embodiment, the polynucleotide is obtained from a natural ergot alkaloid producer selected from the group consisting of: *Aspergillus japonicas* and *Paecilomyces divaricatus*.

A further polypeptide having EasH activity will be comprised in the endophyte comprised in the seeds of *Ipomoea hildebrandtii* Vatke as disclosed in Stauffacher D. et al. (1969) Tetrahedron Vol. 25: p 5879-5887.

Preferably the polypeptides having EasH activity comprise the EasH consensus sequence. The EasH consensus sequence describes consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the EasH sequence alignment of the sequences described by SEQ ID NO: 8 and 95 and shown in FIG. 8.

```
EasH consensus sequence (SEQ ID NO: 156):
MTXTXTSKPXLRRXPXSAGXXAIFQVLQEDGVXXIEGFXXXXQVXXFNXE

XDPHXKXWELGQXSXQEXYLAXMXQLSSLPLFSKXFRDXLMNXXLLHGXC

KXXFGPXSGDYWLTTSSVLETXPGYXGQXLHREHDGIPICTTLGRXSPEX

MLNFLTALTDFTXENGATRVLPGSHLWEDXSXXXXXXDXAIPAXMNPGDA

VLFXGKTLHGAGKNXXXDFLRRGFPLIMQSCQFTPVEASVAXPRXLVETM

TPLAQKMVGWRXVSAKGVXIWTYDLKDLAXGXXLK
```

Preferably the EasH activity of the recombinant microorganism or recombinant natural ergot alkaloid producer organism or recombinant polynucleotides as described for this invention is preferably due to the activity of at least one polypeptide or at least one polynucleotide coding for at least one polypeptide selected from the group of:

a) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 8, b) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and having at least 90%, preferably at least 95%, sequence identity to SEQ ID NO: 156, even more preferred having all amino acids which are 100% conserved in the alignment as shown in FIG. 8, c) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 95, d) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 95, and having at least 90%, preferably at least 95%, sequence identity to SEQ ID NO: 156, even more preferred having all amino acids which are 100% conserved in the alignment as shown in FIG. 8, e) a polypeptide according to at least one of a) to d) which is obtainable from a natural ergot alkaloid producer organism.

The EasA reductase activity of any one of the recombinant microorganism or recombinant natural ergot alkaloid producer organism or recombinant polynucleotides as described for this invention is preferably due to the activity of at least one polypeptide or at least one polynucleotide selected from the group of:

a) a polypeptide comprising an amino acid sequence having at least 90%, 91%, 92%, 93%, 94%, 95%, 96%, 97%, 98%, 99%, or 100% sequence identity to SEQ ID NO: 148, 149 and 150 and having tyrosine at amino acid position 18 of SEQ ID NO: 149, or b) a polypeptide comprising an amino acid sequence having at least 90%, 91%, 92%, 93%, 94%, 95%, 96%, 97%, 98%, 99%, or 100% sequence identity to SEQ ID NO: 193, 194 and 195 and having tyrosine at amino acid position 18 of SEQ ID NO: 194, or c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2 and/or 31, or d) a polypeptide comprising an amino acid sequence having at least 90%, 91%, 92%, 93%, 94%, 95%, 96%, 97%, 98%, 99%, or 100% sequence identity to SEQ ID NO: 2, 31, 32, 33, 34, 35, 36, 37, 38, 39 and/or 40, or e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 103, or f) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 130 and/or 138, or, g) a polypeptide encoded by a polynucleotide obtainable with two PCR-Primers, each comprising at least 15 consecutive nucleotides of a polynucleotide sequence selected from the group of sequences described by SEQ ID NO: 103, 130 and/or 138, or (homologs included in sequence listing)

h) a polypeptide encoded by a polynucleotide which hybridizes under stringent conditions to SEQ ID NO: 103, 130 and/or 138, or i) a polypeptide according to at least two of a) to h), preferably according to at least b) and c) and j) a polypeptide according to at least one of a) to i) which is obtainable from a natural ergot alkaloid producer organism.

A polynucleotide encoding a polypeptide having EasA activity can, in principle, be obtained from any of the natural ergot alkaloid producers mentioned herein. In one embodiment, the polynucleotide is obtained from a natural ergot alkaloid producer selected from the group consisting of:

*Aspergillus terreus, Balansia andropogonis, Balansia cyperi, Balansia obtecta, Balansia pilulaeformis, Claviceps Africana, Claviceps fusiformis, Claviceps hirtella, Sphacelia eriochloae, Sphacelia texensis, Sphacelia lovelessii, Neotyphodium* sp. Lp1, *Neotyphodium coenophialum, Neotyphodium lolii, Penicillium citrinum, Penicillium commune, Penicillium corylophillum, Penicillium crustosum, Penicillium fellutanum* and *Penicillium palitans*, or is consisting of: *Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicillium fellutanum, Penicillium waksmanii, Penicillium roqueforti* and *Paecilomyces divaricatus*, or is consisting of: *Aspergillus japonicus, Aspergillus fumigatus, Claviceps purpurea*, and *Paecilomyces divaricatus*, or is consisting of a group being a combination of any one of these groups.

Preferably, at least one of the polypeptides having EasA activity is selected from the sequences listed in Table 7, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

TABLE 7

%-identity table of exemplary polypeptides having EasA activity

| SEQ ID NO: | 31 | 32 | 33 | 34 | 35 | 36 | 37 | 38 | 39 | 40 |
|---|---|---|---|---|---|---|---|---|---|---|
| *Aspergillus japonicus* SEQ ID NO: 2 | 62% | 65% | 58% | 56% | 54% | 53% | 50% | 52% | 51% | 51% |
| *Paecilomyces divaricatus* SEQ ID NO: 31 | | 66% | 58% | 57% | 56% | 55% | 54% | 55% | 51% | 54% |
| *Aspergillus fumigatus* SEQ ID NO: 32 | | | 57% | 58% | 57% | 53% | 54% | 53% | 52% | 52% |
| *Neotyphodium lolii* SEQ ID NO: 33 | | | | 75% | 72% | 53% | 70% | 52% | 50% | 50% |
| *Periglandula ipomoeae*_SEQ ID NO: 34 | | | | | 79% | 51% | 80% | 49% | 49% | 51% |

TABLE 7-continued

%-identity table of exemplary polypeptides having EasA activity

| SEQ ID NO: | 31 | 32 | 33 | 34 | 35 | 36 | 37 | 38 | 39 | 40 |
|---|---|---|---|---|---|---|---|---|---|---|
| *Claviceps fusiformis* SEQ ID NO: 35 | | | | | | 51% | 74% | 49% | 46% | 49% |
| *Penicillium chrysogenum* SEQ ID NO: 36 | | | | | | | 48% | 69% | 60% | 56% |
| *Claviceps purpurea* SEQ ID NO: 37 | | | | | | | | 47% | 47% | 45% |
| *Aspergillus flavus* SEQ ID NO: 38 | | | | | | | | | 60% | 58% |
| *Neurospora tetrasperma* SEQ ID NO: 39 | | | | | | | | | | 54% |
| *Aspergillus terreus* SEQ ID NO: 40 | | | | | | | | | | |

Preferably the polypeptides having EasA activity comprise at least one of the EasA signature sequences described below. Preferably they comprise at least two of the EasA signature sequences and even more preferred they comprise all three of the EasA signature sequences.

The EasA signature and consensus sequences describe consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the EasA sequence alignment of the sequences specified in Table 7 and shown in FIGS. 9a to 9d. Even more preferred, the polypeptides having EasA activity comprise the full amino acid sequence marked with black bars in FIGS. 9a, 9b and 9c and comprise either an phenylalanine (F) or an Tyrosine (Y) at the amino acid position marked with the black arrow in FIG. 9b.

```
EasA signature sequence 1.1 (SEQ ID NO: 148):
YXQRXXXXGTLLXXXAXXIXXXXXGXXXXPXXXXXXXXXXWXXXXXXVHX

XXXXIXXQLXXXGR

EasA signature sequence 2.1 (SEQ ID NO: 149):
AXXXXXFDGXEXHXXANGXLXDQFXQXXXNXRXDXXGGXXXXRXRF EasA signature sequence 3.1 (SEQ ID NO: 150):
GRXXXSXPDLPF EasA signature sequence 1.2 (SEQ ID NO: 193):
YAQRASVPGTLLITEATXISPRAGGFPNVPGIWXEAQIAAWKXVVDAVHA

KGS-FIFLQLWATGR

EasA signature sequence 2.2 (SEQ ID NO: 194):
AVXAGXFDGVEIHGANGYLIDQFTQXSCNXRTDXWGGSIENRARF EasA signature sequence 3.2 (SEQ ID NO: 195):
GRHFISNPDLPF
```

Preferably the EasA activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:

a) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 2 and having tyrosine at amino acid position 18 of SEQ ID NO: 149, b) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2 and having at least 95%, preferably having 100%, sequence identity to SEQ ID NO: 148, 149 and 150 and having tyrosine at amino acid position 18 of SEQ ID NO: 149, c) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 31 and having tyrosine at amino acid position 18 of SEQ ID NO: 149, d) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 31 and having at least 95%, preferably having 100%, sequence identity to SEQ ID NO: 148, 149 and 150 and having tyrosine at amino acid position 18 of SEQ ID NO: 149, and e) a polypeptide according to at least one of a) to d) which is obtainable from a natural ergot alkaloid producer organism.

A polynucleotide encoding a polypeptide having EasA reductase activity is preferably obtained from the group of natural ergot alkaloid producer organisms selected from the group consisting of: *Aspergillus japonicus, Aspergillus fumigatus, Apergillus flavus, Aspergillus terreus, Claviceps hirtella, Claviceps africana, Penicillium chrysogenum,* and *Paecilomyces divaricatus*.

The EasA isomerase activity of any one of the recombinant microorganism or recombinant natural ergot alkaloid producer organism or recombinant polynucleotides as described for this invention is preferably due to the activity of at least one polypeptide or at least one polynucleotide selected from the group of:

a) a polypeptide comprising an amino acid sequence having at least 90%, 91%, 92%, 93%, 94%, 95%, 96%, 97%, 98%, 99%, or 100% sequence identity to SEQ ID NO: 148, 149 and 150 and having phenylalanine at amino acid position 18 of SEQ ID NO: 149, or b) a polypeptide comprising an amino acid sequence having at least 90%, 91%, 92%, 93%, 94%, 95%, 96%, 97%, 98%, 99%, or 100% sequence identity to SEQ ID NO: 193, 194 and 195 and having phenylalanine at amino acid position 18 of SEQ ID NO: 194, or c) a polypeptide comprising an amino acid sequence having at least 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2 and/or 31, or d) a polypeptide comprising an amino acid sequence having at least 90%, 91%, 92%, 93%, 94%, 95%, 96%, 97%, 98%, 99%, or 100% sequence identity to SEQ ID NO: 2, 31, 32, 33, 34, 35, 36, 37, 38, 39 and/or 40, or e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 103, or f) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 130 and/or 138, or, g) a polypeptide encoded by a polynucleotide obtainable with two PCR-Primers, each comprising at least 15 consecutive nucleotides of a polynucleotide sequence selected from the group of sequences described by SEQ ID NO: 103, 130 and/or 138, or h) a polypeptide encoded by a polynucleotide which hybridizes under stringent conditions to SEQ ID NO: 103, 130 and/or 138, or i) a polypeptide according to at least two of a) to h), and j) a polypeptide according to at least one of a) to i) which is obtainable from a natural ergot alkaloid producer organism.

Preferably the EasA activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:

a) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 2 and having phenylalanine at amino acid position 18 of SEQ ID NO: 149, b) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2 and having at least 95%, preferably having 100%, sequence identity to SEQ ID NO: 148, 149 and 150 and having phenylalanine at amino acid position 18 of SEQ ID NO: 149, c) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 31 and having phenylalanine at amino acid position 18 of SEQ ID NO: 149, d) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 31 and having at least 95%, preferably having 100%, sequence identity to SEQ ID NO: 148, 149 and 150 and having phenylalanine at amino acid position 18 of SEQ ID NO: 149, and e) a polypeptide according to at least one of a) to d) which is obtainable from a natural ergot alkaloid producer organism.

A polynucleotide encoding a polypeptide having EasA isomerase activity is preferably obtained from the group of natural ergot alkaloid producer organisms selected from the group consisting of: *Aspergillus terreus, Balansia andropogonis, Balansia cyperi, Balansia obtecta, Balansia pilulaeformis Claviceps purpurea, Claviceps hirtella Claviceps fusiformis, Claviceps paspali, Claviceps zizaniae, Sphacelia eriochloae, Sphacelia texensis, Sphacelia lovelessii, Neotyphodium* sp. Lp1, *Neotyphodium coenophialum, Neotyphodium lolii, Penicillium citrinum, Penicillium corylophillum, Penicillium fellutanum* and *Periglandula ipomoeae,* or consisting of: *Claviceps purpurea, Claviceps fusiformis, Neotyphodium lolii* and *Periglandula ipomoeae.*

The EasG activity of any one of the recombinant microorganism or recombinant natural ergot alkaloid producer organism or recombinant polynucleotides as described for this invention is preferably due to the activity of at least one polypeptide or at least one polynucleotide selected from the group of:

a) a polypeptide comprising an amino acid sequence having at least 90%, 91%, 92%, 93%, 94%, 95%, 96%, 97%, 98%, 99%, or 100% sequence identity to SEQ ID NO: 155, and/or 183, preferably having at least 90% sequence identity to SEQ ID NO: 183, b) a polypeptide comprising an amino acid sequence having at least 39% 40%, 42%, 44%, 46%, 48%, 50%, 52%, 54%, 56%. 58%, 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7 and/or 86, c) a polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 91, 92, 93 and/or 94, d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 108, e) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 135 and/or 143, f) a polypeptide encoded by a polynucleotide obtainable with two PCR-Primers, each comprising at least 15 consecutive nucleotides of a polynucleotide sequence selected from the group of sequences described by SEQ ID NO: 108, 135 and/or 143, g) a polypeptide encoded by a polynucleotide which hybridizes under stringent conditions to SEQ ID NO: 108, 135 and/or 143, h) a polypeptide according to at least two of a) to g), preferably according to at least a) and b), and i) a polypeptide according to at least one of a) to h) which is obtainable from a natural ergot alkaloid producer organism.

A polynucleotide encoding a polypeptide having EasG activity can, in principle, be obtained from any of the natural ergot alkaloid producer organism mentioned herein. In one embodiment, the polynucleotide is obtained from a natural ergot alkaloid producer selected from the group consisting of:

*Aspergillus terreus, Balansia andropogonis, Balansia cyperi, Balansia obtecta, Balansia pilulaeformis, Claviceps africana, Claviceps fusiformis, Claviceps hirtella, Sphacelia eriochloae, Sphacelia texensis, Sphacelia lovelessii, Neotyphodium* sp. Lp1, *Neotyphodium coenophialum, Neotyphodium lolii, Penicillium citrinum, Penicillium commune, Penicillium corylophillum, Penicillium crustosum, Penicillium fellutanum* and *Penicillium palitans*, or is consisting of: *Aspergillus japonicus, Aspergillus niger, Aspergillus oryzae, Aspergillus nidulans, Aspergillus fumigatus, Claviceps purpurea, Claviceps fusiformis, Claviceps paspali, Claviceps zizaniae, Penicillium chrysogenum, Penicillium citrinum, Penicillium corylophinum, Penicillium fellutanum, Penicillium waksmanii, Penicillium roqueforti* and *Paecilomyces divaricatus*, or is consisting of: *Epichloe festucae, Epichloe glyceriae, Metarhizium acridum, Metarhizium robertsii* and *Trichophyton verrucosum*, or is consisting of: *Aspergillus japonicus, Aspergillus fumigatus, Claviceps purpurea,* and *Paecilomyces divaricatus*, or is consisting of a group being a combination of any one of these groups.

Preferably, at least one of the polypeptides having EasG activity is selected from the sequences listed in Table 8, or polypeptides having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to these.

```
EasG consensus sequence (SEQ ID NO: 155):
XMTILLTGGRGKTASHIASLLXXAXXXVPFIVASRSSSXXXXSPYRXXXF

DWLDEXT YG-NXLSXXDXXXXXGMXPISAVWLVXPPIXDLAPPMIKFID

FARSKGVKRFVLL-SASTIEKGGPAMGXIHAHLDSLXEGIXYXVLRPTWF

MENFSXXXELQWIXIRXEN-KIYSATGDGKIPFISVXDIAR-VAFRALTD

EXSXNTXDYVLLGPELLTYDDVXXXXXXXXXXXXXXXXXXXAEILSTVLG

R-KITHVKLTEAELAXKLXXEXGMPXDDAXMLASMDTXVKXGAEERLNXX

XVKXVTGXXPRT-FLDFASXEKXXWL
```

Preferably the EasG activity of the recombinant microorganism or recombinant natural ergot alkaloid producer organism or recombinant polynucleotides as described for this invention is due to the activity of at least one polypeptide or at least one polynucleotide coding for at least one polypeptide selected from the group of:

a) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 7, b) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7 and having at least 90%, preferably at least 95%, sequence identity to SEQ ID NO: 183, even more preferred having all amino acids which are 100% conserved in the alignment as shown in FIG. 10,

TABLE 8

%-identity table of exemplary polypeptides having EasG activity

| SEQ ID NO: | 7 | 86 | 87 | 88 | 89 | 90 | 181 | 92 | 93 | 94 |
|---|---|---|---|---|---|---|---|---|---|---|
| *Aspergillus japonicus* SEQ ID NO: 7 | | 58% | 62% | 47% | 46% | 45% | 44% | 45% | 39% | 43% |
| *Paecilomyces divaricatus* SEQ ID NO: 86 | | | 64% | 54% | 48% | 53% | 51% | 48% | 44% | 46% |
| *Aspergillus fumigatus* SEQ ID NO: 87 | | | | 50% | 48% | 50% | 50% | 48% | 45% | 47% |
| *Paracoccidioides brasiliensis* SEQ ID NO: 88 | | | | | 48% | 52% | 54% | 47% | 43% | 48% |
| *Claviceps fusiformis* SEQ ID NO: 89 | | | | | | 59% | 58% | 64% | 60% | 61% |
| *Epichloe glyceriae* SEQ ID NO: 90 | | | | | | | 93% | 56% | 54% | 61% |
| *Neotyphodium lolii* SEQ ID NO: 181 | | | | | | | | 57% | 53% | 61% |
| *Claviceps paspali* SEQ ID NO: 92 | | | | | | | | | 58% | 62% |
| *Claviceps purpurea* SEQ ID NO: 93 | | | | | | | | | | 55% |
| *Metarhizium robertsii* SEQ ID NO: 94 | | | | | | | | | | |

Preferably the polypeptides having EasG activity comprise the EasG consensus sequence. The EasG consensus sequence describes consecutive amino acid sequences, wherein each individual amino acid is specified according to the single letter amino acid code used in the art. A amino acid specified with "X" represents any amino acids, preferably it represents an amino acid which is has the same position in at least one of the amino acid sequences of the EasG sequence alignment of the sequences specified in Table 8 and shown in FIGS. 10a and 10b.

c) a polypeptide comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 86, d) a polypeptide comprising an amino acid sequence having at least 60%, 62%, 64%, 66%, 68%, 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 86, and having at least 90%, preferably at least 95%, sequence identity to SEQ ID NO: 183, even more preferred having all amino acids which are 100% conserved in the alignment as shown in FIG. 10, and e) a polypeptide according to at least one of a) to d) which is obtainable from a natural ergot alkaloid producer organism.

All the recombinant microorganisms or recombinant natural ergot alkaloid producer organisms described herein preferably comprise an enlarged cell internal supply of Tryptophan and/or of DMAPP and/or an enlarged cell internal supply of Me-DMAT, as described above. In order to provide the enlarged cell internal supply, it will in most cases be necessary to deregulate endogenous genes of the respective recombinant microorganisms or recombinant natural ergot alkaloid producer organism.

In case the recombinant microorganisms is selected from yeasts, preferably a Saccharomyces spec., even more preferred in case the recombinant microorganism is Saccharomyces cerevisiae, it is one preferred embodiment of the invention, to down-regulate the ERG9 activity (EC 2.5.1.21) by down-regulating an endogenous polypeptide of this recombinant microorganism, comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 9.

Alternatively, or in addition thereto, the internal supply of DMAPP of a yeast, preferably a Saccharomyces spec., even more preferred a Saccharomyces cerevisiae cell can be enlarged by down-regulating a polypeptide having an ERG20 activity (EC 2.5.1.1/2.5.1.10), in particular a polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 10.

Further, the internal supply of DMAPP of a yeast, preferably a Saccharomyces spec., even more preferred a Saccharomyces cerevisiae cell can also be enlarged by up-regulating the genes of the Mevanolate pathway of this organism, for example, by modulating the HMG-CoA reductase activity being due to a polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 11.

Another approach to enlarge the internal supply of precursors of clavine-type alkaloids in a cell is to limit the export of Me-DMAT into the medium. This can be achieved by up-regulating the activity of cell endogenous polypeptides of the Mevalonate pathway. In case the recombinant microorganism is a yeast, preferably a Saccharomyces spec., even more preferred a Saccharomyces cerevisiae cell, this can be achieved by down-regulating the activity of one or more polypeptides comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 12, 13, 14, 15 or 16.

The invention provides the possibility to create new ergot alkaloid producer organisms, in particular new ergot alkaloid producer organisms capable to produce clavine-type alkaloids, by transforming organisms which do not have the capacity to produce ergot alkaloids with the polynucleotides, expression cassettes and/or vectors of the invention.

It many cases it is also of advantage to support proper expression, folding and stability of the recombinant expressed polypeptides by overexpression of genes supporting these functions in the respective recombinant microorganism or recombinant natural ergot alkaloid producer organism.

Genes which can support these functions are, for example, ScIdi1 (SEQ ID No: 158), ScPdi1 (SEQ ID No: 166) and ScFad1 (SEQ ID No: 167).

Accordingly, a further embodiment is a recombinant microorganism or recombinant natural ergot alkaloid producer organism, expressing polypeptides for the production of Cycloclavine, Festuclavine, Agroclavine, Chanoclavine aldehyde or Chanoclavine I, as described herein, which in addition thereto comprise an upregulated activity of at least one polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 158, 166 or 167, preferably having an upregulated activity of at least one polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 166 and 167.

In one embodiment the recombinant microorganism or recombinant natural ergot alkaloid producer organism is yeast, preferably S. cerevisiaee, having upregulated DmaW, EasF, EasE, EasC, EasD, EasH, EasA and EasG activities, as described herein, for the production of Cycloclavine and/or having upregulated DmaW, EasF, EasE, EasC, EasD, EasA and EasG activities, as described herein, for the production of at least one of Festuclavine or Agroclavine. Preferably, this recombinant microorganism or recombinant natural ergot alkaloid producer organism has also an enlarged internal supply of DMAPP, as described above.

A further embodiment of the invention is recombinant S. cerevisiae having upregulated DmaW, EasF, EasE, EasC, EasD, EasH, EasA and EasG activities, as described herein, for the production of Cycloclavine and/or having upregulated DmaW, EasF, EasE, EasC, EasD, EasA and EasG activities, as described herein, for the production of at least one of Festuclavine or Agroclavine and having an upregulated activity of at least one polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 158, 166 and/or 167, preferably having an upregulated activity of at least one polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 166 and 167.

Preferably, the S. cerevisiae having at least a upregulated EasE activity, as described herein, for the production of Cycloclavine, Festuclavine and/or Agroclavine has also an up-regulated activity of at least one polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 187, preferably, the polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 187 is encoded by a polynucleotide having a nucleotide sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 186.

Preferably, this recombinant *S. cerevisiae* has also an enlarged internal supply of DMAPP, as described above, preferably, by down-regulating an endogenous polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 9 or 10, or by down-regulating an endogenous polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 9 and by down-regulating an endogenous polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 10.

Accordingly, further embodiments of the invention are recombinant microorganisms comprising at least one compound selected from the group of compounds of
a) Cycloclavine,
b) Festuclavine,
c) Agroclavine,
d) Chanoclavine aldehyde, and
e) Chanoclavine I,
wherein the recombinant microorganism is not a natural ergot alkaloid producer organism.

Preferably, said recombinant microorganism is a bacterium, a yeast, an actinomycete, or a filamentous fungus, which is not a natural ergot alkaloid producer organism. Such filamentous fungi can be an ascomycete, a deuteromycete, or a basidiomycete.

Preferred bacteria to be used as host cells of the present invention are selected from the group consisting of: *Escherichia coli* and *Bacilus subtilis*.

Preferred recombinant microorganisms are selected from the group consisting of:

Preferred yeast are selected from the group consisting of: *Kluyveromyces, Saccharomyces, Schizosaccharomyces, Yarrowia* and *Pichia*.

More preferred are recombinant microorganisms selected from the group consisting of: *Kluyveromyces lactis, Saccharomyces cerevisiae, Schizosaccharomyces pombe, Yarrowia lipolytica* and *Pichia stipites*.

Even more preferred, the recombinant microorganism is *Saccharomyces cerevisiae*. Different strains of these organisms are readily available to the person skilled in the art, for example, being deposited at public strain collections. Suitable strains of *Saccharomyces cerevisiae* are, for example but not excluding others, BY4742, cGY 1585, Ethanol Red, CEN.PK 111-61A, FY1679-06C, BMA64 (W303), SEY 6210.

In case the recombinant microorganism is a bacterium, in particular *E. coli*, it can be of advantage to overexpress genes of the mevalonate pathway. *E. coli* comprising upregulated genes of the mevalonate pathway are known in the art and for example described in U.S. Pat. No. 7,172,886, U.S. Pat. No. 7,192,751, U.S. Pat. No. 7,667,017, U.S. Pat. No. 7,622,282, U.S. Pat. No. 7,736,882, U.S. Pat. No. 7,622,283, U.S. Pat. No. 7,915,026, and U.S. Pat. No. 8,288,147.

A recombinant microorganism comprising Cycloclavine will preferably comprise at least one polypeptide for each of DmaW, EasF, EasE, EasC, EasD, EasH, EasA and EasG activities, more preferred for each of DmaW, EasF, EasE, EasC, EasD, EasH, EasA reductase and EasG activities.

A recombinant microorganism comprising Festuclavine will preferably comprise at least one polypeptide for each of DmaW, EasF, EasE, EasC, EasD, EasA reductase and EasG activities.

A recombinant microorganism comprising Agroclavine will preferably comprise at least one polypeptide for each of DmaW, EasF, EasE, EasC, EasD, EasA isomerase and EasG activities.

A recombinant microorganism comprising Chanoclavine aldehyde will preferably comprise at least one polypeptide for each of DmaW, EasF, EasE, EasC and EasD activities.

A recombinant microorganism comprising Chanoclavine I will preferably comprise at least one polypeptide for each of DmaW, EasF, EasE and EasC activities.

A recombinant microorganism comprising Me-DMAT will preferably comprise at least one polypeptide for each of DmaW and EasF activities.

A recombinant microorganism comprising DMAT will preferably comprise at least one polypeptide for DmaW activity.

It is also possible to produce recombinant microorganism comprising Cycloclavine, Festuclavine, Agroclavine, Chanoclavine aldehyde, or Chanoclavine I or a combination of at least two of these compounds, but having less than the activities necessary to produce the respective compound or compounds from the cell internal pools of Tryptophane and DMAPP. The missing activities can be compensated by providing the recombinant microorganism with the necessary precursors via other means, e.g. by providing the precursors to the growth medium.

Accordingly one embodiment of the invention is a recombinant microorganism comprising Cycloclavine, which is provided with DMAT and comprises at least one polypeptide for each of EasF, EasE, EasC, EasD, EasH, EasA and EasG activities, more preferred for each of EasF, EasE, EasC, EasD, EasH, EasA reductase and EasG activities.

A further embodiment is a recombinant microorganism comprising Cycloclavine, which is provided with Me-DMAT and comprises at least one polypeptide for each of EasE, EasC, EasD, EasH, EasA and EasG activities, more preferred for each of EasE, EasC, EasD, EasH, EasA reductase and EasG activities.

An even further embodiment is a recombinant microorganism comprising Cycloclavine, which is provided with Chanoclavine I and comprises at least one polypeptide providing for each of EasD, EasH, EasA and EasG activities, more preferred for each of EasD, EasH, EasA reductase and EasG activities.

Further embodiments are a recombinant microorganism comprising Festuclavine, which is provided with DMAT and comprises at least one polypeptide for each of EasF, EasE, EasC, EasD, EasA reductase and EasG activities.

A recombinant microorganism comprising Festuclavine, which is provided with Me-DMAT and comprises at least one polypeptide for each of EasE, EasC, EasD, EasA reductase and EasG activities.

A recombinant microorganism comprising Festuclavine, which is provided with Chanoclavine I and comprises at least one polypeptide for each of EasD, EasA reductase and EasG activities.

A recombinant microorganism comprising Festuclavine, which is provided with Chanoclavine aldehyde and comprises at least one polypeptide for each of EasA reductase and EasG activities.

A recombinant microorganism comprising Agroclavine, which is provided with DMAT and comprises at least one polypeptide for each of EasF, EasE, EasC, EasD, EasA isomerase and EasG activities.

A recombinant microorganism comprising Agroclavine, which is provided with Me-DMAT and comprises at least one polypeptide for each of EasE, EasC, EasD, EasA isomerase and EasG activities.

A recombinant microorganism comprising Agroclavine, which is provided with Chanoclavine I and comprises at least one polypeptide for each of EasD, EasA isomerase and EasG activities.

A recombinant microorganism comprising Agroclavine, which is provided with Chanoclavine aldehyde and comprises at least one polypeptide for each of EasA isomerase and EasG activities.

A recombinant microorganism comprising Chanoclavine aldehyde, which is provided with DMAT and comprises at least one polypeptide for each of EasF, EasE, EasC and EasD activities.

A recombinant microorganism comprising Chanoclavine aldehyde, which is provided with Me-DMAT and comprises at least one polypeptide for each of EasE, EasC and EasD activities.

A recombinant microorganism comprising Chanoclavine aldehyde, which is provided with Chanoclavine I and comprises at least one polypeptide for EasD activity.

A recombinant microorganism comprising Chanoclavine I, which is provided with DMAT and comprises at least one polypeptide for each of EasF, EasE and EasC activities.

A recombinant microorganism comprising Chanoclavine I, which is provided with Me-DMAT and comprises at least one polypeptide for EasE and EasC activity.

Depending on further activities comprised by the cell, the content of Cycloclavine, Festuclavine, Agroclavine, Chanoclavine aldehyde or Chanoclavine I or a combination of at least two of these compounds may be low or high.

For Example, a recombinant microorganism comprising Agroclavine, but also comprising activities which use Agroclavine as an educt to produce a product, e.g. elymoclavine or setoclavine, or comprise an activity facilitating the export of Agroclavine into the surrounding medium, may comprise a low content of Agroclavine.

Similar, a recombinant microorganism comprising Festuclavine, but also comprising activities which use Festuclavine as an educt to produce a product, e.g. Fumiclavine B, A or C, or to produce dihydroergot alkaloids, or comprise an activity facilitating the export of Festuclavine into the surrounding medium, may comprise a low content of Festuclavine.

A recombinant microorganism comprising Chanoclavine aldehyde, but also comprising activities which use Chanoclavine aldehyde as an educt to produce a product, e.g. Festuclavine or Agroclavine, or comprise an activity facilitating the export of Chanoclavine aldehyde into the surrounding medium, may comprise a low content of Chanoclavine aldehyde.

A recombinant microorganism comprising Chanoclavine I, but also comprising activities which use Chanoclavine I as an educt to produce a product, e.g. Cycloclavine, Chanoclavine aldehyde or 6,7-secolyergine or comprise an activity facilitating the export of Chanoclavine I into the surrounding medium, may comprise a low content of Chanoclavine I.

However, in case the activities using the respective compound as an educt or facilitating the export of this compound into the surrounding medium are down-regulated, the content of the compound in the recombinant microorganism can be high.

The invention provides further the possibility to create recombinant natural ergot alkaloid producer organism which have an enhanced production of one or more ergot alkaloids, if compared to their non-recombinant form. It is also possible to change the kind of ergot alkaloids usually produced by a natural ergot alkaloid producer, in particular to change the production of clavine-type alkaloids produced by a natural ergot alkaloid producer, by down-regulating endogenous genes for ergot alkaloid production or by introducing one or more of the DmaW, EasF, EasE, EasC, EasD, EasH, EasA and EasG activities disclosed herein.

The enhanced production of one or more ergot alkaloids is, preferably, statistically significant when compared to a control organism which lacks expression of the polynucleotide of the present invention and is preferably the wild-type organism, i.e. a non-recombinant organisms, of the same species and preferably same strain, which has been used to construct the recombinant natural ergot alkaloid producer organism and is when grown under the same conditions as the recombinant natural ergot alkaloid producer organism when used as a control organism.

Whether an increase is significant can be determined by statistical tests well known in the art including, e.g., Student's t-test. More preferably, the increase is an increase of the amount of the respective ergot alkaloid of at least 5%, at least 10%, at least 15%, at least 20% or at least 30% compared to said control organism. Suitable assays for measuring the amount of ergot alkaloids are described in the accompanying Examples and known in the art.

Accordingly, further embodiments of the invention are recombinant natural ergot alkaloid producer organism comprising at least one compound selected from the group of compounds of Cycloclavine, Festuclavine, Agroclavine, Chanoclavine aldehyde and/or Chanoclavine I, wherein the recombinant natural ergot alkaloid producer organism if of a species of a natural ergot alkaloid producer organism which does not produce this compound in nature.

In addition to that, the polypeptides and polynucletotides of the invention can also be used to enhance the production of Cycloclavine, Festuclavine, Agroclavine, Chanoclavine aldehyde and/or Chanoclavine I of a natural ergot alkaloid producer organism, by creating a recombinant natural ergot alkaloid producer organism having at least one up-regulated or at least one down-regulated, or at least one up-regulated and at least one down-regulated activity selected from the group of DmaW, EasF, EasE, EasC, EasD, EasH, EasA and EasG activities.

Accordingly further embodiments of the invention are recombinant natural ergot alkaloid producer organisms comprising and/or producing at least one of the compounds selected from the group of: Cycloclavine, Festuclavine, Agroclavine, Chanoclavine aldehyde and/or Chanoclavine I at or to a higher amount as compared to the non-recombinant wild-type organism when grown under the same conditions.

The respective wild-type organism used for comparison will preferably be of the same species and preferably be of the same strain, which has been used to create the respective recombinant natural ergot alkaloid producer organism.

A recombinant recombinant natural ergot alkaloid producer organism comprising Cycloclavine or producing Cycloclavine, will comprise at least one up-regulated EasH activity, preferably will comprise at least one up-regulated EasH activity and at least one DmaW, EasF, EasE, EasC, EasD, EasA and/or EasG activity, more preferred will comprise at least one up-regulated EasH activity and at least one DmaW, EasF, EasE, EasC, EasD, EasA reductase and/or EasG activity and even more preferred will comprise at least one up-regulated EasH activity and at least one up-regulated DmaW, EasF, EasE, EasC, EasD, EasA reductase and/or EasG activity and at least one down-regulated EasA isomerase activity.

A recombinant natural ergot alkaloid producer organism comprising Festuclavine or producing Festuclavine will comprise at least one up-regulated DmaW, EasF, EasE, EasC, EasD, EasA reductase or EasG activity, preferably at least one up-regulated DmaW, EasF, EasE, EasC, EasD, EasA reductase or EasG activity and at least one down-regulated EasA isomerase and/or EasH activity.

A recombinant natural ergot alkaloid producer organism comprising Agroclavine or producing Agroclavine, will comprise at least one up-regulated DmaW, EasF, EasE, EasC, EasD, EasA isomerase and/or EasG activity, preferably at least one up-regulated DmaW, EasF, EasE, EasC, EasD, EasH, EasA isomerase and/or EasG activity and at least one down-regulated EasA reductase and/or EasH activity.

A recombinant natural ergot alkaloid producer organism comprising Chanoclavine aldehyde or producing Chanoclavine aldehyde will comprise at least one upregulated DmaW, EasF, EasE, EasC and/or EasD activity or at least one down-regulated EasA, EasG and/or EasH activity, preferably will comprise at least one up-regulated DmaW, EasF, EasE, EasC and/or EasD activity and at least one down-regulated EasA, EasG and/or EasH activity.

A recombinant natural ergot alkaloid producer organism comprising Chanoclavine I or producing Chanoclavine I will comprise at least one up-regulated DmaW, EasF, EasE and/or EasC activity, or at least one down-regulated EasD, EasA, EasG and/or EasH activity, or will comprise at least one up-regulated DmaW, EasF, EasE and/or EasC activity and at least one down-regulated EasD, EasA, EasG and/or EasH activity.

It is also possible to produce recombinant natural ergot alkaloid producer organism comprising and/or producing Cycloclavine, Festuclavine, Agroclavine, Chanoclavine aldehyde, Chanoclavine I or a combination of at least two of these compounds, but having less than the activities necessary to produce the respective compound or compounds from the cell internal pools of Tryptophane and DMAPP. The missing activities can be compensated by providing the recombinant natural ergot alkaloid producer organism with the necessary precursors via other means, e.g. by providing the precursors to the growth medium.

Accordingly one embodiment of the invention is a recombinant natural ergot alkaloid producer organism comprising Cycloclavine, which is provided with DMAT and comprises at least one polypeptide for each of EasF, EasE, EasC, EasD, EasH, EasA and EasG activities, more preferred for each of EasF, EasE, EasC, EasD, EasH, EasA reductase and EasG activities.

A further embodiment is a recombinant natural ergot alkaloid producer organism comprising Cycloclavine, which is provided with Me-DMAT and comprises at least one polypeptide for each of EasE, EasC, EasD, EasH, EasA and EasG activities, more preferred for each of EasE, EasC, EasD, EasH, EasA reductase and EasG activities.

An even further embodiment is a recombinant natural ergot alkaloid producer organism comprising Cycloclavine, which is provided with Chanoclavine I and comprises at least one polypeptide providing for each of EasD, EasH, EasA and EasG activities, more preferred for each of EasD, EasH, EasA reductase and EasG activities.

Further embodiments are a recombinant natural ergot alkaloid producer organism comprising Festuclavine, which is provided with DMAT and comprises at least one polypeptide for each of EasF, EasE, EasC, EasD, EasA reductase and EasG activities.

A recombinant natural ergot alkaloid producer organism comprising Festuclavine, which is provided with Me-DMAT and comprises at least one polypeptide for each of EasE, EasC, EasD, EasA reductase and EasG activities.

A recombinant natural ergot alkaloid producer organism comprising Festuclavine, which is provided with Chanoclavine I and comprises at least one polypeptide for each of EasD, EasA reductase and EasG activities.

A recombinant natural ergot alkaloid producer organism comprising Festuclavine, which is provided with Chanoclavine aldehyde and comprises at least one polypeptide for each of EasA reductase and EasG activities.

A recombinant natural ergot alkaloid producer organism comprising Agroclavine, which is provided with DMAT and comprises at least one polypeptide for each of EasF, EasE, EasC, EasD, EasA isomerase and EasG activities.

A recombinant natural ergot alkaloid producer organism comprising Agroclavine, which is provided with Me-DMAT and comprises at least one polypeptide for each of EasE, EasC, EasD, EasA isomerase and EasG activities.

A recombinant natural ergot alkaloid producer organism comprising Agroclavine, which is provided with Chanoclavine I and comprises at least one polypeptide for each of EasD, EasA isomerase and EasG activities.

A recombinant natural ergot alkaloid producer organism comprising Agroclavine, which is provided with Chanoclavine aldehyde and comprises at least one polypeptide for each of EasA isomerase and EasG activities.

A recombinant natural ergot alkaloid producer organism comprising Chanoclavine aldehyde, which is provided with DMAT and comprises at least one polypeptide for each of EasF, EasE, EasC and EasD activities.

A recombinant natural ergot alkaloid producer organism comprising Chanoclavine aldehyde, which is provided with Me-DMAT and comprises at least one polypeptide for each of EasE, EasC and EasD activities.

A recombinant natural ergot alkaloid producer organism comprising Chanoclavine aldehyde, which is provided with Chanoclavine I and comprises at least one polypeptide for EasD activity.

A recombinant natural ergot alkaloid producer organism comprising Chanoclavine I, which is provided with DMAT and comprises at least one polypeptide for each of EasF, EasE and EasC activities.

A recombinant natural ergot alkaloid producer organism comprising Chanoclavine I, which is provided with Me-DMAT and comprises at least one polypeptide for EasE and EasC activity.

Preferably, the recombinant natural ergot alkaloid producer organism is selected from the group consisting of: The genus *Aspergillus* such as *Aspergillus japonicus, Aspergillus niger, Aspergillus oryzae, Aspergillus nidulans, Aspergillus fumigatus, Aspergillus aculeatus, Aspergillus caesiellus, Aspergillus candidus, Aspergillus carneus, Aspergillus clavatus, Aspergillus deflectus, Aspergillus fischerianus, Aspergillus flavus, Aspergillus glaucus, Aspergillus nidulans, Aspergillus ochraceus, Aspergillus parasiticus, Aspergillus penicilloides, Aspergillus restrictus, Aspergillus sojae, Aspergillus tamari, Aspergillus terreus, Aspergillus ustus, Aspergillus versicolor;* the genus *Penicillium* such as *Penicillium aurantiogriseum, Penicillium bilaiae, Penicillium camemberti, Penicillium candidum, Penicillium chrysogenum, Penicillium claviforme, Penicillium commune, Penicillium crustosum, Peni-* cillium digitatum, Penicillium expansum, Penicillium funiculosum, Penicillium glabrum, Penicillium glaucum, Penicillium italicum, Penicillium lacussarmientei, Penicillium mameffei, Penicillium purpurogenum, Penicillium roqueforti, Penicillium stoloniferum, Penicillium ulaiense, Penicillium verrucosum, Penicillium viridicatum;
the genus Claviceps such as Claviceps africana, Claviceps fusiformis, Claviceps hirtella, Claviceps paspali, Claviceps purpurea, Claviceps sorghi, Claviceps zizaniae.
the genus Paecilomyces such as Paecilomyces divaricatus.

Even more preferred are recombinant natural ergot alkaloid producer organisms selected from the group consisting of: Aspergillus japonicus, Aspergillus niger, Aspergillus oryzae, Aspergillus nidulans, Aspergillus fumigatus, Penicillium chrysogenum, Paecilomyces divaricatus, Penicillium roqueforti.

A further embodiment of the invention is a recombinant natural ergot alkaloid producer organism comprising and/or producing Cycloclavine, wherein the recombinant natural ergot alkaloid producer organism is not of the species Aspergillus japonicus or Paecilomyces divaricatus, or is of the species, Aspergillus fumigatus, or Claviceps purpurea.

A further embodiment of the invention is a recombinant natural ergot alkaloid producer organism comprising and/or producing Festuclavine wherein the recombinant natural ergot alkaloid producer organism is not of the species Aspergillus japonicus, Aspergillus fumigatus, Apergillus flavus, Apergillus terreus, Claviceps hirtella, Claviceps africana, Penicillium chrysogenum, and Paecilomyces divaricatus,
or is of the species, Aspergillus terreus, Balansia andropogonis, Balansia cyperi, Balansia obtecta, Balansia pilulaeformis Claviceps purpurea, Claviceps hirtella Claviceps fusiformis, Claviceps paspali, Claviceps zizaniae, Sphacelia eriochloae, Sphacelia texensis, Sphacelia lovelessii, Neotyphodium sp. Lp1, Neotyphodium coenophialum, Neotyphodium lolii, Penicillium citrinum, Penicillium corylophillum, Penicillium fellutanum and Periglandula ipomoeae,
or consisting of Claviceps purpurea, Claviceps fusiformis, Neotyphodium lolii and Periglandula ipomoeae.

A further embodiment of the invention is a recombinant natural ergot alkaloid producer organism comprising and/or producing Agroclavine wherein the recombinant natural ergot alkaloid producer organism is not of the species Aspergillus terreus, Balansia andropogonis, Balansia cyperi, Balansia obtecta, Balansia pilulaeformis Claviceps purpurea, Claviceps hirtella Claviceps fusiformis, Claviceps paspali, Claviceps zizaniae, Sphacelia eriochloae, Sphacelia texensis, Sphacelia lovelessii, Neotyphodium sp. Lp1, Neotyphodium coenophialum, Neotyphodium lolii, Penicillium citrinum, Penicillium corylophillum, Penicillium fellutanum and Periglandula ipomoeae, or consisting of: Claviceps purpurea, Claviceps fusiformis, Neotyphodium lolii and Periglandula ipomoeae,
or is of the species, Aspergillus japonicus, Aspergillus fumigatus, Apergillus flavus, Apergillus terreus, Claviceps hirtella, Claviceps africana, Penicillium chrysogenum, and Paecilomyces divaricatus.

Preferably at least one of the up-regulated or down-regulated DmaW, EasF, EasE, EasC, EasH, EasD, EasA or EasG activities of any one of the recombinant natural ergot alkaloid producer organisms described above is provided by at least one polypeptide, or at least one polynucleotide coding for at least one polypeptide, selected from the group of:

a) a polypeptide comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 2, 3, 4, 5, 6, 7, 8, 20, 31, 41, 53, 64, 75, 86, and/or 95.

d) a polypeptide encoded by a polynucleotide having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 102, 122 or 123, 129, 130, 131, 132, 133, 134, 135 and/or 136 or e) a polypeptide encoded by a polynucleotide obtainable with two PCR-Primers, each comprising at least 15 consecutive nucleotides of a polynucleotide sequence selected from the group of sequences described by SEQ ID NO: 102, 122, 123, 129, 130, 131, 132, 133, 134, 135 and/or 136 or f) a polypeptide encoded by a polynucleotide which hybridizes under stringent conditions to SEQ ID NO: 102, 122 or 123, 123, 129, 130, 131, 132, 133, 134, 135 and/or 136 and g) a polypeptide according to at least one of a) to f) which is obtainable from Aspergillus japonicus or Paecilomyces divaricatus.

Tables 9 to 14 list exemplary non-limiting examples of combinations of recombinant polynucleotides encoding for polypeptides having the listed DmaW, EasF, EasE, EasC, EasA, EasG, EasD or EasH activities, which have at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to the polypeptide sequence having the respective DmaW, EasF, EasE, EasC, EasA, EasG, EasD or EasH activity and comprised by the Source Organism mentioned in the tables. Each X in the table represents one copy of a recombinant polynucleotide comprised by the recombinant microorganism or recombinant natural ergot alkaloid producer organism.

TABLE 9

Cycloclavine production in a recombinant natural ergot alkaloid producer organism
A. japonicus, A. fumigatus, P. divaricatus, C. paspali

| Embodiment No. | Source Organism | DmaW | EasF | EasE | EasC | EasA | EasG | EasD | EasH |
|---|---|---|---|---|---|---|---|---|---|
| 1 | A. japonicus | X | X | X | X | X | X | X | X |
| 2 | A. fumigatus | X | X | X | X | X | X | X | X |
| 3 | A. japonicus |  |  |  |  | X | X | X | X |
|  | A. fumigatus | X | X | X | X |  |  |  |  |
| 4 | A. japonicus | X |  |  |  | X | X | X | X |
|  | A. fumigatus |  |  |  | X |  |  |  |  |
|  | P. divaricatus |  | X | X | X |  |  | X | X |

TABLE 9-continued

Cycloclavine production in a recombinant natural ergot alkaloid producer organism
*A. japonicus, A. fumigatus, P. divaricatus, C. paspali*

| Embodiment No. | Source Organism | DmaW | EasF | EasE | EasC | EasA | EasG | EasD | EasH |
|---|---|---|---|---|---|---|---|---|---|
| 5 | *A. japonicus* |  |  |  |  |  |  |  | XX |
|  | *A. fumigatus* | X |  |  |  |  |  |  |  |
|  | *P. divaricatus* |  |  |  |  | X | X | X | X |
|  | *C. purpurea* | X | X | X | X |  |  |  |  |

TABLE 10

Festuclavine production in a recombinant natural ergot alkaloid producer organism
*A. japonicus, A. fumigatus, P. divaricatus, C. paspali*

| Embodiment No. | Source Organism | DmaW | EasF | EasE | EasC | EasA | EasG | EasD | EasH |
|---|---|---|---|---|---|---|---|---|---|
| 1 | *A. japonicus* | X | X | X | X | X | X | X |  |
|

TABLE 12-continued

Cycloclavine production in a recombinant non natural ergot alkaloid producer organism, like a *Saccharomyces*, *Yarrowia* or *Pichia* species

| Embodiment No. | Source Organism | DmaW | EasF | EasE | EasC | EasA | EasG | EasD | EasH |
|---|---|---|---|---|---|---|---|---|---|
| 4 | A. japonicus |  |  |  | X |  |  |  | X |
|  | C. purpurea | X | X | X | X | X | X | X | X |
| 5 | A. japonicus | X |  |  | X | X | X | X | X |
|  | P. divaricatus | X | X | X | X |  |  |  | X |
| 6 | A. japonicus | X |  |  | X | X | X | X | X |
|  | A. fumigatus |  | X |  |  |  |  |  |  |
|  | P. divaricatus |  |  |  | X | X |  |  | X | X |
| 7 | A. japonicus | X |  |  |  |  |  |  | XX |
|  | A. fumigatus |  | X |  |  |  |  |  |  |
|  | P. divaricatus |  |  |  |  | X | X | X | X |
|  | C. purpurea | X |  |  | X | X |  |  |  |
| 8 | A. japonicus | X |  |  | X | XX |  |  | XX |
|  | A. fumigatus |  | X |  |  |  |  |  |  |
|  | P. divaricatus |  |  |  |  | X | X | X | X |
|  | C. purpurea | X |  |  | X | X |  |  |  |
| 9 | A. japonicus | XX |  |  | XX | XXX | X | X | X | XXX |
|  | A. fumigatus |  | X |  |  |  |  |  |  |
| 10 | A. japonicus | X |  |  | XX | X | X | X | X | XX |
|  | A. fumigatus |  | X |  |  |  |  |  |  |
|  | P. divaricatus |  |  |  |  | X |  |  |  |
|  | C. purpurea | X |  |  |  | X |  |  | X | in *S. cerevisiae* it is of advantage to overexpress the endogenous ScPdi1, ScFad1 and/or ScEro1 as well

TABLE 13

Festuclavine production in a recombinant non natural ergot alkaloid producer organism, like a *Saccharomyces*, *Yarrowia* or *Pichia* species

| Embodiment No. | Source Organism | DmaW | EasF | EasE | EasC | EasA | EasG | EasD | EasH |
|---|---|---|---|---|---|---|---|---|---|
| 1 | P. divaricatus | X | X | X | X | X | X | X |  |
| 2 | A. japonicus | X |  | X | X | X | X | X |  |
|  | A. fumigatus |  | X |  |  |  |  |  |  |
| 3 | A. japonicus |  |  |  |  | XX | X | X |  |
|  | A. fumigatus | X | X | X | X |  |  |  |  |
| 4 | A. japonicus |  |  |  | X |  |  |  |  |
|  | P. divaricatus | X | X | X | X | X | X | X |  |
| 5 | A. japonicus | X |  |  | XXX | X | X | X |  |
|  | P. divaricatus | X | X | X |  | X |  |  |  |
| 6 | A. japonicus | X |  |  | X | X | X | X |  |
|  | A. fumigatus |  | X |  |  |  |  |  |  |
|  | P. divaricatus |  |  | X | X |  |  | X |  |
| 7 | A. japonicus | X |  |  | X | X |  |  |  |
|  | A. fumigatus |  | X |  |  |  |  |  |  |
|  | P. divaricatus |  |  |  |  | X | X | X |  |
|  | C. purpurea | X |  | X | X |  |  |  |  |
| 8 | A. japonicus | X |  | X | XX |  |  |  |  |
|  | A. fumigatus |  | X |  |  |  |  |  |  |
|  | P. divaricatus |  |  |  |  | X | X | X |  |
|  | C. purpurea | X |  | X | X |  |  |  |  |
| 9 | A. japonicus | XX |  | XX | XXX | X | X | X |  |
|  | A. fumigatus |  | X |  |  |  |  |  |  |
| 10 | A. japonicus | X |  | XX | X | X | X | X |  |
|  | A. fumigatus |  | X |  |  |  |  |  |  |
|  | P. divaricatus |  |  |  | X |  |  |  |  |
|  | C. purpurea | X |  |  | X |  |  |  |  | in *S. cerevisiae* it is of advantage to overexpress the endogenous ScPdi1, ScFad1 and/or ScEro1 as well

TABLE 14

Agroclavine production in a recombinant non natural ergot alkaloid producer organism, like a *Saccharomyces*, *Yarrowia* or *Pichia* species

| Embodiment No. | Source Organism | DmaW | EasF | EasE | EasC | EasA | EasG | EasD | EasH |
|---|---|---|---|---|---|---|---|---|---|
| 1 | A. japonicus | X | X | X | X |   | X | X |   |
|   | C. purpurea |   |   |   |   | X |   |   |   |
| 2 | A. japonicus | X |   | X | X |   | X | X |   |
|   | C. purpurea |   | X |   |   | X |   |   |   |
| 3 | A. japonicus |   |   |   |   |   | X | X |   |
|   | C. purpurea |   | X | X | X | X |   |   |   |
| 4 | P. divaricatus | X | X | X | X |   | X | X |   |
|   | C. purpurea |   |   |   | X | X |   |   |   |
| 5 | A. japonicus | X |   |   | X |   | X | X |   |
|   | C. purpurea | X | X | X | X | X |   |   |   |
| 6 | A. japonicus | X |   |   | X |   | X |   |   |
|   | P. divaricatus |   | X | X | X | X |   | X |   |
|   | C. purpurea | X | X |   |   | X | X | X |   |
| 7 | A. japonicus | X |   |   |   |   |   |   |   |
|   | A. fumigatus |   | X |   |   |   |   |   |   |
|   | P. divaricatus |   |   |   |   |   | X | X |   |
|   | C. purpurea | X |   | X | X | XX |   |   |   |
| 8 | A. japonicus | X |   | X | XX |   |   |   |   |
|   | A. fumigatus |   | X |   |   |   |   |   |   |
|   | P. divaricatus |   |   |   |   |   | X | X |   |
|   | C. purpurea | X |   | X | X | XX |   |   |   |
| 9 | A. japonicus | XX |   | XX | XXX |   | X | X |   |
|   | C. purpurea |   | X |   |   | X |   |   |   |
| 10 | A. japonicus | X |   | X | XX |   | X | X |   |
|   | A. fumigatus |   | X |   |   |   |   |   |   |
|   | P. divaricatus |   |   | X | X |   |   |   |   |
|   | C. purpurea | X |   |   | X | XX |   |   |   | in *S. cerevisiaee* it is of advantage to overexpress the endogenous ScPdi1, ScFad1 and/or ScEro1 as well A person skilled in the art will be able to create further embodiments similar to the ones listed in Tables 9 to 14.

Particular preferred embodiments are yeasts, preferably *S. cerevisiaee*, and their use as recombinant microorganism for the production of Cycloclavine, wherein the yeasts, preferably *S. cerevisiaee*, comprise a) at least one expression cassette comprising a polynucleotide encoding a polypeptide having EasH activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95 and having at least 90%, preferably at least 95%, sequence identity to SEQ ID NO: 156, even more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95 and having all amino acids which are 100% conserved in the alignment as shown in FIG. 8.

b) at least one expression cassette comprising a polynucleotide encoding a polypeptide having an EasA reductase activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2, 31, 32, 33, 34, 35, 36, 37, 38, 39 and/or 40, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2, 31, 32, 33, 34, 35, 36, 37, 38, 39 and/or 40 and having at least 95%, preferably having 100%, sequence identity to SEQ ID NO: 148, 149 and 150 and having tyrosine at amino acid position 18 of SEQ ID NO: 149, c) at least one expression cassette comprising a polynucleotide encoding a polypeptide having an EasG activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 181, 92, 93 and/or 94, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 181, 92, 93 and/or 94, and having at least 90%, preferably at least 95%, sequence identity to SEQ ID NO: 183, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 181, 92, 93 and/or 94 and having all amino acids which are 100% conserved in the alignment as shown in FIG. 10, d) at least one expression cassette comprising a polynucleotide encoding a polypeptide having an EasD activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63 and having at least 80%, preferably at least 81%, sequence identity to SEQ ID NO: 152, more preferred having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63 and having all amino acids which are 100% conserved in the alignment as shown in FIG. 7, e) at least one expression cassette comprising a polynucleotide encoding a polypeptide having an EasC activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52 and having at least 85%, preferably at least 87%, sequence identity to SEQ ID NO: 192, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52 and having all amino acids which are 100% conserved in the alignment as shown in FIG. 6, f) at least one expression cassette comprising a polynucleotide encoding a polypeptide having an EasE activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178 and having at least 70%, preferably at least 73%, sequence identity to SEQ ID NO: 191, more preferred, comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178 having all amino acids which are 100% conserved in the alignment as shown in FIG. 5, g) at least one expression cassette comprising a polynucleotide encoding a polypeptide having an EasF activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85 and having at least 75%, preferably at least 79%, sequence identity to SEQ ID NO: 154, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85 and having all amino acids which are 100% conserved in the alignment as shown in FIG. 4, h) at least one expression cassette comprising a polynucleotide encoding a polypeptide having a DmaW activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28 and having at least 85%, preferably at least 89%, sequence identity to SEQ ID NO: 190, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28 and having all amino acids which are 100% conserved in the alignment as shown in FIG. 3.

Preferably, the polypeptide providing the EasE activity has an N-terminal sequence which can function as sorting signal to the endoplasmatic reticulum in yeast. In case the recombinant microorganism is *S. cerevisiaee* the polypeptide providing the EasE activity will preferably comprise an N-terminal sequence which can function as sorting signal to the endoplasmatic reticulum in *S. cerevisiaee*.

Preferably the polynucleotides encoding the polypeptides providing the DmaW, EasF, EasE, EasC, EasD, EasH, EasA reductase and/or EasG activity have a polynucleotide sequence which can be obtained from a natural ergot alkaloid producer organism.

Preferred variants of these yeasts are the embodiments described in Table 12.

Further variants of these yeasts can be used to produce Agroclavine, Festuclavine. Those yeast will preferably not comprise an expression cassette comprising a polynucleotide encoding a polypeptide having an EasH activity.

Preferred variants of these yeasts are the embodiments described in Tables 13 and 14.

Further variants of these yeasts can be used to produce Chanoclavine I, but will not comprise an expression cassette comprising a polynucleotide encoding a polypeptide having an EasH, EasA, EasG or EasD activity.

Further variants of these yeasts will comprise expression cassettes comprising a polynucleotides encoding a polypeptides having an EasH, EasA, EasG and EasD activity, but no expression cassettes comprising a polynucleotide encoding a polypeptide having an DmaW, EasF, EasE or EasC activity. These yeasts can be used to produce Cycloclavine, when provided with Chanoclavine I.

Further variants of these yeasts will comprise expression cassettes comprising a polynucleotides encoding a polypeptides having an EasA, EasG and EasD activity, but no expression cassettes comprising a polynucleotide encoding a polypeptide having an DmaW, EasF, EasE, EasC or EasH activity. These yeasts can be used to produce Festuclavine or Agroclavine, when provided with Chanoclavine I.

Particular preferred embodiments are yeasts, preferably *S. cerevisiaee*, and their use as recombinant microorganism for the production of Cycloclavine, wherein the yeasts, preferably *S. cerevisiaee*, comprise a) at least one expression cassette comprising a polynucleotide encoding a polypeptide having EasH activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95 and having at least 90%, preferably at least 95%, sequence identity to SEQ ID NO: 156, even more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 8 and/or 95 and having all amino acids which are 100% conserved in the alignment as shown in FIG. 8.

b) at least one expression cassette comprising a polynucleotide encoding a polypeptide having an EasA reductase activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2, 31, 32, 33, 34, 35, 36, 37, 38, 39 and/or 40, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 2, 31, 32, 33, 34, 35, 36, 37, 38, 39 and/or 40 and having at least 95%, preferably having 100%, sequence identity to SEQ ID NO: 148, 149 and 150 and having tyrosine at amino acid position 18 of SEQ ID NO: 149, c) at least one expression cassette comprising a polynucleotide encoding a polypeptide having an EasG activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 181, 92, 93 and/or 94, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 181, 92, 93 and/or 94, and having at least 90%, preferably at least 95%, sequence identity to SEQ ID NO: 183, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 7, 86, 87, 88, 89, 90, 181, 92, 93 and/or 94 and having all amino acids which are 100% conserved in the alignment as shown in FIG. 10, d) at least one expression cassette comprising a polynucleotide encoding a polypeptide having an EasD activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63 and having at least 80%, preferably at least 81%, sequence identity to SEQ ID NO: 152, more preferred having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 4, 53, 54, 55, 56, 57, 58, 59, 60, 62 and/or 63 and having all amino acids which are 100% conserved in the alignment as shown in FIG. 7, e) at least two expression cassettes comprising a polynucleotide encoding a polypeptide having an EasC activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52 and having at least 85%, preferably at least 87%, sequence identity to SEQ ID NO: 192, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 3 or 41, 42, 43, 44, 45, 46, 47, 48, 49, 50, 51 and/or 52 and having all amino acids which are 100% conserved in the alignment as shown in FIG. 6, f) at least two expression cassettes comprising a polynucleotide encoding a polypeptide having an EasE activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178 and having at least 70%, preferably at least 73%, sequence identity to SEQ ID NO: 191, more preferred, comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 5, 64, 175, 66, 67, 68, 69, 176, 71, 177, 73 and/or 178 having all amino acids which are 100% conserved in the alignment as shown in FIG. 5, g) at least one expression cassette comprising a polynucleotide encoding a polypeptide having an EasF activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85 and having at least 75%, preferably at least 79%, sequence identity to SEQ ID NO: 154, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 6, 75, 76, 77, 78, 79, 80, 81, 82, 83, 84 and/or 85 and having all amino acids which are 100% conserved in the alignment as shown in FIG. 4, h) at least one expression cassette comprising a polynucleotide encoding a polypeptide having a DmaW activity comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28, preferably comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28 and having at least 85%, preferably at least 89%, sequence identity to SEQ ID NO: 190, more preferred comprising an amino acid sequence having at least 70%, 72%, 74%, 76%, 78%, 80%, 82%, 84%, 86%, 88%, 90%, 91%, 92%, 93%, 94%, 95%, 96%, 97%, 98%, 99%, or 100% sequence identity to SEQ ID NO: 1, 19, 20, 21, 22, 23, 24, 25, 26, 27 and/or 28 and having all amino acids which are 100% conserved in the alignment as shown in FIG. 3.

Preferably those yeasts comprise a) at least one expression cassette comprising a polynucleotide encoding a polypeptide having a DmaW activity comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 28, preferably comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 28 and having at least 85%, preferably at least 89%, sequence identity to SEQ ID NO: 190, more preferred comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 28 and having all amino acids which are 100% conserved in the alignment as shown in FIG. 3 and/or b) at least one expression cassette comprising a polynucleotide encoding a polypeptide having a EasF activity comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 76, preferably comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 76 and having at least 75%, preferably at least 79%, sequence identity to SEQ ID NO: 154, more preferred comprising an amino acid sequence having at least 80%, 82%, 84%, 86%, 88%, 90%, 91%, 92%, 93%, 94%, 95%, 96%, 97%, 98%, 99%, or 100% sequence identity to SEQ ID NO: 76 and having all amino acids which are 100% conserved in the alignment as shown in FIG. 4.

Further variants of these yeasts can be used to produce Agroclavine, Festuclavine. Those yeast will preferably not comprise an expression cassette comprising a polynucleotide encoding a polypeptide having an EasH activity.

Further variants of these yeasts can be used to produce Chanoclavine I, but will not comprise an expression cassette comprising a polynucleotide encoding a polypeptide having an EasH, EasA, EasG or EasD activity.

The recombinant microorganisms or recombinant natural ergot-alkaloid producer organisms disclosed herein can be produced via standard transformation and/or mutation protocols used in the art. The most efficient methods for each respective species are readily available in the literature, for example, in Turgeon (2010) Molecular and cell biology methods for fungi, p 3-9, in Koushki, M M et al., (2011), AFRICAN JOURNAL OF BIOTECHNOLOGY Vol. 10 (41): p 7939-7948, in Coyle et al. (2010) Appl Environ Microbiol 76:3898-3903, in Current Protocols in Molecular Biology, Chapter 13. Eds Ausubel F. M. et al. Wiley & Sons, U.K., and in Genome Analysis: A Laboratory Manual, Cloning Systems. Volume 3. Edited by Birren B, Green E D, Klapholz S, Myers R M, Riethman H, Roskams J. New York: Cold Spring Harbor Laboratory Press; 1999:297-565.

These methods involve recombinant polynucleotides coding for polypeptides comprising at least one of the DmaW, EasF, EasE, EasC, EasD, EasH, EasA or EasG activities. These polynucleotides can be targeted to integrate in already existing expression cassettes of the microorganism of interest or can be comprised in recombinant expression cassettes which enable the transcription and translation of the polynucleotides in the respective microorganism. The expression cassettes comprise a promoter and a terminator being operably linked to the polynucleotide coding for at least one of the DmaW, EasF, EasE, EasC, EasD, EasH, EasA and EasG activity providing polypeptides. The polynucleotides coding for at least one of the polypeptides will preferably be adapted to the codon usage of the respective microorganism. Promoters, terminators and information about codon usage suitable to be used for a particular microorganism are known by a person skilled in the art.

Suitable constitutive promoters for yeasts, in addition to the ones listed in the examples, are in particular for *Saccharomyces cerevisiae* are for example the trpC, gpdA, tub2 and Tef1 promoters.

Suitable inducible promoters for yeasts, in particular for *Saccharomyces cerevisiae*, are for example the Gal1, Gal10, Cup1, Pho5, and Met25 promoters.

Further Promoters and terminators, as well as cloning strategies are described, for example, in Shao et al. (2009) Nucleic Acids Research, Vol. 37, No. 2 e16 (10 pages).

The expression cassettes described above may or may not be comprised by larger polynucleotides, which can be used for transformation, or which can be created by targeted integration of several constructs in, or close to one genomic locus. These larger polynucleotides can comprise expression cassettes for one or more polypeptides providing the same activity or can comprise expression cassettes for one or more polypeptides providing different activities, or may comprise expression cassettes for one or more polypeptides providing the same activity and comprise expression cassettes for one or more polypeptides providing different activities. Alternatively, or in addition to the methods and polynucleotides described above, the recombinant microorganism can be transformed several times or can be transformed with several different polynucleotides at the same time and thus comprise the expression cassettes at two or more loci in the genome of the recombinant microorganism.

Thus, further embodiments of the invention are recombinant polynucleotides encoding a polypeptide as described in any one of the embodiments above and expression cassettes for expression of a polynucleotide encoding a polypeptide as described in any one of the embodiments above and vectors, including expression and transformation vectors, comprising at least one of such polynucleotides or expression cassettes.

The recombinant microorganism or recombinant natural ergot alkaloid producer organism as described in any of the embodiments above can be used for the production of at last one of Cycloclavine, Festuclavine, Agroclavine, Chanoclavine aldehyde, I and Chanoclavine, which are also comprised by the current invention. Thus, further embodiments comprise methods for the production of at least one of Cycloclavine, Festuclavine, Agroclavine, Chanoclavine aldehyde and Chanoclavine I comprising:

a) cultivating a recombinant microorganism or recombinant natural ergot alkaloid producer organism as described in any one of the embodiments above under conditions which allow the production of at least one of Cycloclavine, Festuclavine, Agroclavine, Chanoclavine aldehyde and Chanoclavine I in the recombinant microorganism or recombinant natural ergot alkaloid producer organism; and b) obtaining at least one of Cycloclavine, Festuclavine, Agroclavine, Chanoclavine aldehyde and Chanoclavine I from said recombinant microorganism or the recombinant natural ergot alkaloid producer organism and/or the culture medium.

The recombinant microorganism or recombinant natural ergot alkaloid producer organism of the invention can be grown in surface-culture, submerged-culture, solid-state culture, saprotrophic culture, in shaking flask culture or in any other way, which fits to the intended purpose. Preferably, the recombinant microorganism or recombinant natural ergot alkaloid producer organism are cultured in submerged-culture.

Growth conditions and growth media for the recombinant microorganisms and recombinant natural ergot alkaloid producer organisms are known by the person skilled in the art, e.g. the conditions used to cultivate the non-recombinant microorganisms and natural ergot producer organisms can be applied. Such protokolls and methods are, for example, disclosed in Bacon C W (1985) Mycologia Vol 77:418-423, in Schulz B, et al. (1993) Mycol Res 97:1447-1450, in Banks, et al. (1974) Journal of General Microbiology Vol 82: p 345-361, in Flieger, M. et al. (1997) Folia Microbiologica Vol. 42: p 3-30, in Pažoutová, S. et al. (1981) Journal of Natural Products Vol. 44: p 225-235.

Culturing methods and methods to induce or enhance the production of ergot alkaloids by natural ergot alkaloid producer organisms have been disclosed, for example, in Keller, U. and Tudzynski, P. (2002) in: Osiewacz, H. D. (Ed.), The Mycota, Vol. X. "Industrial Applications". Springer, Berlin, pp. 157-181, in Haarmann, T., et al., (2005), Phytochemistry Vol. 66, p 1312-1320, or in Furuta, T et al. (1982) Agricultural and Biological Chemistry, Vol 46 (7): p 1921-1922, in Tudzynski P. et al., (2001) Applied Microbiology and Biotechnology, Vol. 57 (5-6) p 593-605, in Kantorova, M., et al, (2002) Journal of Natural Products, Vol. 65 (7): p 1039-1040, in Kozlovsky, A. G.; (2010) Applied Biochemistry and Microbiology, Vol. 46 (5): p 525-529, in Kozlovsky, A. G.; (1999) Applied Biochemistry and Microbiology Vol. 35 (5): p 477-485, in Narayan V. and Rao K. K., (1982) Biotechnology Letters Vol. 4 (3): p 193-196, in Rehacek, Z. et al., (1970) Folia Microbiologica Vol 15 (3): p 210-213, in Narayan V. and Rao K. K., (1982) Biotechnology Letters Vol. 4 (3): p 193-196, in Rehacek, Z. et al., (1971) Folia Microbiologica Vol 15 (3): p 35-40, in Janardhanan K. and Husain A. (1990) Indian Journal of Experimental Biology, Vol. 28(11): p 1054-1057, in Hernandesz M. et al., (1992) Letters in Applied Microbiology Vol. 15(4): p 156-159, in Hernandesz M. et al., (1993) Process Biochemistry Vol. 28(1): p 23-27, in Sarkisova M. et al. (1991) Antibiotiki I Khimioperapiya Vol 36(12): p 8-10, in Samdani G et al., (1998) Asian Journal of Chemistry Vol. 10(2): p 373-374.

For example, the production of ergot alkaloids by *Claviceps purpurea* can be improved by adding Tryptophan as precursor and inductor to the growth medium, which has preferably a high osmotic value and a low phosphate level.

Further, the production of ergot alkaloids by *Claviceps purpurea, Claviceps fusiformis* or *Claviceps paspali* grown on infected rye ears can be improved by adding ergot alkaloid precursors.

Further guidance on how to use *Claviceps purpurea* for the production of ergot alkaloids can be found in: Hulvová H. et al. "Parasitic fungus *Claviceps* as a source for biotechnological production of ergot alkaloids" Biotechnology Advances 31 (2013) 79-89.

The recombinant microorganisms and recombinant natural ergot alkaloid producer organisms can be cultured, for example, using, glucose, sucrose, honey, dextrin, starch, glycerol, molasses, animal or vegetable oils and the like as the carbon source for the culture medium. Furthermore, soybean flour, wheat germ, corn steep liquor, cotton seed waste, meat extract, polypeptone, malt extract, yeast extract, ammonium sulfate, sodium nitrate, urea and the like can be used for the nitrogen source. The addition of inorganic salts which can produce sodium, potassium, calcium, magnesium, cobalt, chlorine, phosphoric acid (dipotassium hydrogen phosphate and the like), sulfuric acid (magnesium sulfate and the like) and other ions as required is also effective. Furthermore, various vitamins such as thiamine (thiamine hydrochloride and the like), amino acids such as glutamine (sodium glutamate and the like), asparagine (DL-asparagine and the like), trace nutrients such as nucleotides and the like, and selection drugs such as antibiotics and the like can also be added as required. Moreover, organic substances and inorganic substances can be added appropriately to assist the growth of the organism and promote the production of ergot alkaloids, in particular the production of Cycloclavine, Festuclavine, Agroclavine, Chanoclavine aldehyde, and/or Chanoclavine I. The pH of the culture medium is, for example, of the order of pH 5.5 to pH 8. The culturing can be carried out with a method such as the solid culturing method under aerobic conditions, the concussion culturing method, the air-passing agitation culturing method or the deep aerobic culturing method, but the deep aerobic culturing method is the most suitable. The appropriate temperature for culturing is from 10° C. to 40° C., but in many cases growth occurs in the range from 22° C. to 30° C. The production of Cycloclavine, Festuclavine, Agroclavine, Chanoclavine aldehyde, and/or Chanoclavine I differs according to the culture medium and culturing conditions, or the host which is being used, but with any culturing method the accumulation of production of Cycloclavine, Festuclavine, Agroclavine, Chanoclavine aldehyde and/or Chanoclavine I reaches a maximum generally in from 2 to 10 days, but can go on for considerable longer times, e.g 15, 20, 25, 30, 40, 50 days or even longer. The culturing is stopped when the amount of production of Cycloclavine, Festuclavine, Agroclavine, Chanoclavine aldehyde and/or Chanoclavine I in the culture reaches its highest level and the target material is isolated from the culture and refined for isolating production of Cycloclavine, Festuclavine, Agroclavine, Chanoclavine aldehyde and/or Chanoclavine I thereof from the culture material. The target material used for isolating of production of Cycloclavine, Festuclavine, Agroclavine, Chanoclavine aldehyde and/or Chanoclavine I can be any useful material, e.g. the organism itself, which may be the whole organism or only the spores produced by the organism or any other part of the organism, or the culture medium used to cultivate the organism. The culturing conditions can be adapted to enhance the production of Cycloclavine, Festuclavine, Agroclavine, Chanoclavine aldehyde, and/or Chanoclavine I, for example by providing the recombinant microorganisms or recombinant natural ergot alkaloid producer organisms with one or more precursors of Cycloclavine, Festuclavine, Agroclavine, Chanoclavine aldehyde, and/or Chanoclavine I, such precursors are preferably selected from the group of IPP, Tryptophan, DMAPP, DMAT, Me-DMAT and Chanoclavine I.

Thus, a further embodiment of the invention is a method for the production of at least one of Cycloclavine, Festuclavine, Agroclavine, Chanoclavine aldehyde and Chanoclavine I, comprising:
a) cultivating a recombinant microorganism or recombinant natural ergot alkaloid producer organism as described in any one of the embodiments above under conditions which allow for the production of at least one of Cycloclavine, Festuclavine, Agroclavine, Chanoclavine aldehyde and Chanoclavine I in the recombinant microorganism or recombinant natural ergot alkaloid producer organism;
b) providing said recombinant microorganism or recombinant natural ergot alkaloid producer organism with at least one of the compounds selected from the group of IPP, Tryptophan, DMAPP, DMAT, Me-DMAT or Chanoclavine I via the culture medium, and
c) obtaining at least one of Cycloclavine, Festuclavine, Agroclavine, Chanoclavine aldehyde, and Chanoclavine I from the recombinant microorganism or the recombinant natural ergot alkaloid producer organism and/or the culture medium.

The methods described above are preferably used to obtain at least one of the compounds selected from the group of Cycloclavine, Festuclavine, Agroclavine, Chanoclavine aldehyde and Chanoclavine I. Preferable, the methods are used to obtain Cycloclavine.

However, the method step of obtaining Festuclavine, Agroclavine, Chanoclavine aldehyde, Chanoclavine I can also be omitted, in particular if the recombinant microorganism or recombinant natural ergot alkaloid producer organism comprises further genes, which use at least one of Festuclavine, Agroclavine, Chanoclavine aldehyde or Chanoclavine I as educt for the production of other ergot alkaloids, like pyroclavine, fumiclavine A or C, or ergotamine. It may then be of advantage to obtain these compounds from the organism or the culture medium. For example, in case the recombinant natural ergot alkaloid producer organism is Aspergillus fumigatus, it will be possible to produce and obtain ergot alkaloids like Fumigaclavine B, Fumigaclavine A or Fumigaclavine. Further, in case the recombinant natural ergot alkaloid producer organism is a Claviceps species, preferably Claviceps purpurea, Claviceps paspali or Claviceps africana, it will be possible to produce and obtain one or more of the compounds selected from the group of elymoclavine, paspalic acid, lysergic acid, ergopeptams and ergopeptines. The same principle will apply to other recombinant natural ergot producer organisms, which produce one or more ergot alkaloids and use least one of Festuclavine, Agroclavine, Chanoclavine aldehyde or Chanoclavine I as precursor for their production. Preferably, the natural ergot alkaloid producer will produce at least one of these other ergot alkaloids in a higher amount, at a higher rate, if compared to the same species and strain, which has been used to create the respective natural ergot alkaloid producer organism. A higher rate, or higher amount means, at least 5%, 10%, 15%, 30%, 40%, 50%, 60%, 70%, 80%, 90%, or at least 100% more or faster, if compared to the same species and strain, which has been used to create the respective natural ergot alkaloid producer organism, when both are cultivated under the same conditions.

The culturing conditions can vary in regard to the recombinant microorganism or recombinant natural ergot alkaloid producer organism used. Suitable growth conditions or yeasts, in particular Saccaromyces cerevisiae are provided in the Examples. However, these growth conditions may be adapted further. For example, the growth temperature can be adapted for slow or fast growth of the organism. Accordingly, the invention encompasses methods for the production of at least one of Cycloclavine, Festuclavine, Agroclavine, Chanoclavine aldehyde and Chanoclavine I, wherein in the recombinant microorganism or recombinant natural ergot alkaloid producer organism is cultivated at a temperature between 10° C. to 40° C., preferably between 15° C. to 35° C., more preferred between 18° C. to 32° C., even more preferred between 20° C. to 30° C. or wherein the recombinant microorganism or recombinant natural ergot alkaloid producer organism is cultivated at a temperature between 10° C. and 32° C., between 13° C. and 32° C., between 15° C. and 32° C., between 16° C. and 32° C., between 17° C. and 32° C., between 18° C. and 32° C., between 19° C. and 32° C. between 20° C. and 32° C., between 15° C. and 31° C., between 15° C. and 30° C., between 15° C. and 29° C., between 15° C. and 28° C., between 15° C. and 27° C., between 15° C. and 26° C., between 15° C. and 25° C., or wherein the recombinant microorganism or recombinant natural ergot alkaloid producer organism is first cultivated at a temperature between 25° C. and 40, preferably between 25° C. and 35° C., followed by a temperature between 10° C. and 25° C., preferably between 15° C. and 25° C., or wherein the recombinant microorganism or recombinant natural ergot alkaloid producer organism is first cultivated at a temperature between 10° C. and 25° C., preferably between 15° C. and 25° C., followed by a temperature between, 25° C. and 40, preferably between 25° C. and 35° C.

Usually the growth conditions are selected according to the preferences of the respective recombinant microorganism or recombinant natural ergot alkaloid producer organism, however it may be of advantage to deviate from that. For example, it can be of advantage to grow S. cerevisia at temperatures between 15° C. and 25° C., preferably at 20° C., for the production of Cycloclavine, Festuclavine, Agroclavine, Chanoclavine aldhyde and/or Chanoclavine I.

In some embodiments, the growth conditions of the respective recombinant microorganism or recombinant natural ergot alkaloid producer organism, e.g. S. cerevisia are selected to slow down growth. This may be achieved, for example, by adding glycerol, Trimethylamine N-oxide (TMAO) or prolin to the growth medium, for example, glycerol at a concentration of 2.5%, 5% or 10%, TMAO at a concentration at 250 mM or 500 mM or prolin at a concentration of 200 mM.

A further preferred embodiment uses feed batch culturing conditions, which can be used to generate high cell densities and/or to prolong the fermentation.

The Cycloclavine, Festuclavine, Agroclavine, Chanoclavine aldhyde and/or Chanoclavine I produced by a method as described herein is preferably obtained via extraction, but can, in principle, also be obtained via other methods.

In one embodiment the extraction is performed via extraction with a compound selected from the group of: Ethyl Acetate (EA), Tert-Butyl MethylEther (TBME), Chloroform (CHCl3) and Di-chloromethane (DCM).

Preferably an extraction method comprises Liquid/Liquid Extraction with Ethyl Acetate at pH=10, and more preferred Liquid/Liquid Extraction with Ethyl Acetate at pH=10 wherein the pH is adjusted with NaOH.

However, it is also possible to obtain Cycloclavine, Festuclavine, Agroclavine, Chanoclavine aldhyde and/or Chanoclavine I via an extraction method comprising extraction with a Solid Phase Extraction with silica based resin material, preferably selected from the group of HLB resin, preferably at pH=3, Diaion resin at pH=3, Amberlite 1180 resin, preferably at pH=3, Amberlite 1180 resin, preferably at pH=10, Amberlite 16N resin, preferably at pH=3 or Amberlite 16N resin, preferably at pH=10.

Methods suitable to obtain Cycloclavine, Festuclavine, Agroclavine, Chanoclavine aldhyde and/or Chanoclavine I, or other clavine-type alkaloids or other ergot alkaloids are known by persons skilled in the art. For example, a method to obtain Cycloclavine is disclosed in Furuta et al., (1982), Agricultural and Biological Chemistry Vol. 46 (7): p 1921-1922 or in Stauffacher D. et al. (1969) Tetrahedron Vol. 25: p 5879-5887.

Methods to analyse ergot alkaloids are, for example, described in Flieger, M. et al., (1997) Folia Microbiolgica, Vol. 42 (1) p 3-29 and in Halada, P. et al., (1998) Chemicke Listy Vol. 92 (7) p 538-547.

The invention comprise the use of a recombinant microorganism or recombinant natural ergot alkaloid producer organism, a recombinant polynucleotide, a vector as described in any one of the embodiments above, for the production of at least one of Cycloclavine, Festuclavine, Agroclavine, Chanoclavine aldhyde and Chanoclavine I or in any one of the methods described above.

Further embodiments of the invention comprise Cycloclavine, Festuclavine, Agroclavine, Chanoclavine aldhyde and/or Chanoclavine I produced by any one of the methods described above and culture media comprising at least one of the compounds selected from the group of Cycloclavine, Festuclavine, Agroclavine, Chanoclavine aldhyde and Chanoclavine I and being produced by cultivation of a recombinant microorganism or a recombinant natural ergot alkaloid producer organism of the invention.

Preferably, the culture medium comprises Cycloclavine, but no or a comparatively low content of at least one of Festuclavine, Agroclavine, Chanoclavine aldhyde and Chanoclavine I. Equally preferred, the culture medium comprises Festuclavine, but no or a comparatively low content of at least one of Cycloclavine, Agroclavine, Chanoclavine aldhyde and Chanoclavine I. Equally preferred, culture medium comprises Agroclavine, but no or a comparatively low content of at least one of Cycloclavine, Festuclavine, Chanoclavine aldhyde and Chanoclavine I. Also equally preferred, culture medium comprises Chanoclavine aldhyde, but no or a comparatively low content of at least one of Cycloclavine, Festuclavine, Agroclavine and Chanoclavine I. Also equally preferred, the culture medium comprises Chanoclavine I, but no or a comparatively low content of at least one of Cycloclavine, Festuclavine, Agroclavine and Chanoclavine aldhyde.

Comparatively low content means a content of the respective compound, which is at least 10%, 20%, 30%, 40% 50%, 60%, 70%, 80%, 100% lower when compared to the content in a culture medium, which has been produced by culturing the respective control organism of the recombinant microorganism or a recombinant natural ergot alkaloid producer organism in question.

The invention further comprises polynucleotides isolated from *Paecilomyces divaricatus* and sequence variants thereof, which can be used to create a recombinant microorganism or a recombinant natural ergot alkaloid producer organism as described above.

Accordingly, one embodiment of the invention is a polynucleotide comprising one or more nucleic acid sequences selected from the group consisting of:

a) a nucleic acid sequence having a nucleotide sequence as shown in SEQ ID NO: 129, 130, 131, 132, 133, 134, 135 or 136;
b) a nucleic acid sequence encoding a polypeptide having an amino acid sequence as shown in SEQ ID NOs: 20, 31, 41, 53, 64, 75, 86, 95 or 180;
c) a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 129, 130, 131, 132, 133, 134, 135 or 136 wherein said nucleic acid sequence encodes a polypeptide having DmaW, EasF, EasE, EasC, EasD, EasH, EasA reductase, EasA isomerase or EasG activity;
d) a nucleic acid sequence encoding a polypeptide having DmaW, EasF, EasE, EasC, EasD, EasH, EasA reductase, EasA isomerase or EasG activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 20, 31, 41, 53, 64, 75, 86, 95 or 180; and
e) a nucleic acid sequence which is capable of hybridizing under stringent conditions to any one of a) to d), wherein said nucleic acid sequence encodes a polypeptide having DmaW, EasF, EasE, EasC, EasD, EasH, EasA reductase, EasA isomerase or EasG activity.

Further embodiments of the invention comprise polypeptides and sequence variants thereof, which can be used to create a recombinant microorganism or a recombinant natural ergot alkaloid producer organism as described above.

Accordingly, one embodiment of the invention is a polynucleotide comprising one or more nucleic acid sequences selected from the group consisting of:

a) a nucleic acid sequence encoding a polypeptide having an amino acid sequence as shown in SEQ ID NOs: 175, 176, 177 or 178;
b) a nucleic acid sequence encoding a polypeptide having EasE activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 175, 176, 177 or 178;
c) a nucleic acid sequence encoding a polypeptide having an amino acid sequence as shown in SEQ ID NOs: 181, and
d) a nucleic acid sequence encoding a polypeptide having DmaW activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 181.

These polynucleotides isolated from *Paecilomyces divaricatus* and sequence variants thereof as well as the nucleic acid sequences encoding a polypeptide having EasE or DmaW activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 175, 176, 177, 178, or 181 can be combined with any one of the polynucleotides described in any one of the embodiments described herein, preferably with a polynucleotide encoding a polypeptide having DmaW, EasF, EasE, EasC, EasD, EasH, EasA reductase, EasA isomerase or EasG activity.

The polynucleotides can further be operably linked with promoter and terminator sequences, to create expression cassettes for the transcription and translation of the encoded polypeptides. Further, these polynucleotides and expression cassettes can be introduced into transformation and or expression vectors and for example be used to create recombinant microorganism or a recombinant natural ergot alkaloid producer organism of the invention or to produce the encoded polypeptide having DmaW, EasF, EasE, EasC, EasD, EasH, EasA reductase, EasA isomerase or EasG activity for further purification, e.g. for the purpose to produce antibodies recognizing these polypeptides or to produce protein crystals of such polypeptides, or to use the polypeptides for in-vitro tests and production methods. Accordingly, the invention encompasses prokaryotic and eukaryotic host cells comprising such a polynucleotide. Preferably such host cell is a bacterial cell, a fungi cell, or a yeast cell. A further embodiment of the invention is a method for the manufacture of a polypeptide comprising: a) cultivating host cells comprising an expression cassette for a nucleic acid sequence encoding a polypeptide having DmaW, EasF, EasE, EasC, EasD, EasH, EasA reductase, EasA isomerase or EasG activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 20, 31, 41, 53, 64, 75, 86 or 95 or cultivating *Paecilomyces divaricatus* cells under conditions which allow for the production of the polypeptide; and b) obtaining the polypeptide from the host cells or *Paecilomyces divaricatus* cells of step a).

Also encompassed by the invention is a method for the manufacture of Cycloclavine, Festuclavine, Agroclavine, Chanoclavine aldehyde or Chanoclavine I, or of a combination of these, comprising: a) cultivating *Paecilomyces divaricatus* cells under conditions which allow for the production of Cycloclavine, Festuclavine, Agroclavine, Chanoclavine aldehyde or Chanoclavine I; and b) obtaining at least one of Cycloclavine, Festuclavine, Agroclavine, Chanoclavine aldehyde or Chanoclavine I from the *Paecilomyces divaricatus* cells and/or the culture medium.

Other parts of the invention comprise the use of a polynucleotide comprising one or more nucleic acid sequences selected from the group consisting of:
a) a nucleic acid sequence having a nucleotide sequence as shown in SEQ ID NO: 129, 130, 131, 132, 133, 134, 135 or 136;
b) a nucleic acid sequence encoding a polypeptide having an amino acid sequence as shown in SEQ ID NOs: 20, 31, 41, 53, 64, 75, 86 or 95;
c) a nucleic acid sequence being at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the nucleic acid sequence as shown in SEQ ID NO: 129, 130, 131, 132, 133, 134, 135 or 136, wherein said nucleic acid sequence encodes a polypeptide having DmaW, EasF, EasE, EasC, EasD, EasH, EasA reductase, EasA isomerase or EasG activity;
d) a nucleic acid sequence encoding a polypeptide having DmaW, EasF, EasE, EasC, EasD, EasH, EasA reductase, EasA isomerase or EasG activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 20, 31, 41, 53, 64, 75, 86 or 95; and
e) a nucleic acid sequence which is capable of hybridizing under stringent conditions to any one of a) to d), wherein said nucleic acid sequence encodes a polypeptide having DmaW, EasF, EasE, EasC, EasD, EasH, EasA reductase, EasA isomerase or EasG activity, or the use of a vector, or a host cell or a *Paecilomyces divaricatus* cell comprising these polynucleotides for the manufacture of at least one of the compounds selected from the group of Cycloclavine, Festuclavine, Agroclavine, Chanoclavine aldehyde and Chanoclavine I or for the manufacture of at least one ergot alkaloid, which is produced by using at least one of the compounds selected from the group of Cycloclavine, Festuclavine, Agroclavine, Chanoclavine aldehyde and Chanoclavine I as a precursor.

Other parts of the invention comprise the use of a polynucleotide comprising one or more nucleic acid sequences selected from the group consisting of:
a) a nucleic acid sequence encoding a polypeptide having an amino acid sequence as shown in SEQ ID NOs: 175, 176, 177 or 178;
b) a nucleic acid sequence encoding a polypeptide having EasE activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 175, 176, 177 or 178;
c) a nucleic acid sequence encoding a polypeptide having an amino acid sequence as shown in SEQ ID NOs: 181, and
d) a nucleic acid sequence encoding a polypeptide having DmaW activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 181.

or the use of a vector, or recombinant microorganism or a recombinant natural ergot alkaloid producer organism, preferably an *Aspergillus japonicus, Aspergillus fumigatus, Paecilomyces divaricatus, Claviceps purpurea, Claviceps paspali, Claviceps africanus* or a yeast cell, comprising these polynucleotides for the manufacture of at least one of the compounds selected from the group of Cycloclavine, Festuclavine, Agroclavine, Chanoclavine aldehyde and Chanoclavine I or for the manufacture of at least one ergot alkaloid, which is produced by using at least one of the compounds selected from the group of Cycloclavine, Festuclavine, Agroclavine, Chanoclavine aldehyde and Chanoclavine I as precursor.

A further embodiment of the invention refers to a recombinant microorganism or a recombinant natural ergot alkaloid producer organism expressing at least one polypeptide selected from the group consisting of:
a) a polypeptide having an amino acid sequence as shown in SEQ ID NOs: 175, 176, 177 or 178;
b) a polypeptide having EasE activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 175, 176, 177 or 178;
c) a polypeptide having an amino acid sequence as shown in SEQ ID NOs: 181, and
d) a polypeptide having DmaW activity and having an amino acid sequence which is at least 70%, 72%, 74%, 76%, 78%, 80%, 82%, 84%, 86%, 88%, 90%, 91%, 92%, 93%, 94%, 95%, 96%, 97%, 98%, 99%, or 100% identical to the amino acid sequence as shown in SEQ ID NOs: 181.

Preferably, the recombinant microorganism or a recombinant natural ergot alkaloid producer organism expressing such polypeptides is an *Aspergillus japonicus, Aspergillus* fumigatus, *Paecilomyces divaricatus, Claviceps purpurea, Claviceps paspali, Claviceps africanus* or a yeast cell.

EXAMPLES

Example 1: Production of Cycloclavine in Baker's Yeast (*Saccharomyces Cerevisiae*)

Materials and Methods:

The basic yeast strain EYS1456, used in these experiments, had the following genotype: CEN.PK 111-61A (MATα MAL2-8C SUC2 his3Δ1 leu2-3_112 ura3-52)
Genes Used in Example 1 are Listed in Table 15:

TABLE 15

List of genes used in this experiment

| Gene name | Seq. ID | Source of sequence |
| --- | --- | --- |
| Aj_DmaW_altC | 102 | *A. japonicus* |
| Af_EasF | 107 | *A. fumigatus* |
| Aj_EasE | 106 | *A. japonicus* |
| Aj_EasC | 104 | *A. japonicus* |
| Aj_EasD | 105 | *A. japonicus* |
| Aj_EasH | 109 | *A. japonicus* |

TABLE 15-continued

List of genes used in this experiment

| Gene name | Seq. ID | Source of sequence |
| --- | --- | --- |
| Aj_EasA | 103 | *A. japonicus* |
| Aj_EasG | 108 | *A. japonicus* |

Cloning of Genes:

Synthetic genes, codon optimized for expression in yeast, were manufactured. The genes encode the amino acid sequences (SEQ ID NO: 102-108) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (SEQ ID NO: 110 and 111) containing the native yeast promoters and terminators separated by a multiple cloning site comprising Hind III and Sac II. All cassettes were flanked by Asc I restriction sites. The gene expression cassettes (SEQ ID NO: 110 and 111) were comprised on a pUC18 based plasmid vector (SEQ ID NO: 112) into which a linker (SEQ ID NO: 113) had been inserted to provide an Asc I site for cloning of the expression cassettes.

Gene expression cassettes were used for sub-cloning either one or two cassettes into designated Integration Vectors (SEQ ID NO: 114-118), which also contained a yeast selectable marker gene. In the case of two expression cassettes the orientation of cloning was head to head, meaning that promoters would allow transcription in opposite directions. The marker and expression cassette(s) were flanked by sequences with homology to the genomic DNA of the host (SEQ ID NO: 114-118). The entire integration construct, comprising the expression cassette(s) and selection marker, flanked by the homologous sequences, were released from the pUC18 based backbone by digesting the Integration Vectors with the Not I and Sbf I restriction enzymes, and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target sites for integration are described by Flagfeldt, 2009. SEQ ID NO: of the Integration Vectors and their integration constructs are listed in Table 16a and Table 16 mmb.

TABLE 16a

Integration Vectors with integration constructs and genomic target site

| Construct name | SEQ ID NO: | Cassette 1 | | | Cassette 2 | | |
| --- | --- | --- | --- | --- | --- | --- | --- |
| | | Promoter | Gene | Terminator | Promoter | Gene | Terminator |
| pEVE2294 | 114 | ScPgk1 | AfEasF | ScAdh1 | ScGpd1 | AjDmaW_altC | ScCyc1 |
| pEVE2312 | 115 | ScPgk1 | AjEasC | ScAdh1 | ScGpd1 | AjEasE | ScCyc1 |
| pEVE2342 | 116 | ScPgk1 | AjEasD | ScAdh1 | | | |
| pEVE2343 | 117 | ScPgk1 | AjEasD | ScAdh1 | ScGpd1 | AjEasH | ScCyc1 |
| pEVE2344 | 118 | ScPgk1 | AjEasA | ScAdh1 | ScGpd1 | AjEasG | ScCyc1 |

TABLE 16b

Integration Vectors with integration constructs and genomic target site

| Construct name | SEQ ID NO: | Marker | Destination region |
| --- | --- | --- | --- |
| pEVE2294 | 114 | KanMX | YORWΔ17 |
| pEVE2312 | 115 | HygR | YPRCΔ15 |
| pEVE2342 | 116 | BleR | YORWΔ22 |
| pEVE2343 | 117 | BleR | YORWΔ22 |
| pEVE2344 | 118 | NatR | YPRC$_T$3 |

Pathway Assembly:

Two yeast strains were prepared by integrating, into EYS1456, either a complete cycloclavine pathway, or a pathway lacking the gene EasH. EYS1849 was prepared by integrating the constructs from pEVE2294, pEVE2312, pEVE2343, and pEVE2344 (Table 16a and 16b), whereas EYS1851 was prepared by integrating the constructs from pEVE2294, pEVE2312, pEVE2342, and pEVE2344 (Table 16a and 16b). The resulting strains thus contained the expression cassettes for the following genes:

EYS1849: AjDmaW_altC, AfEasF, AjEasE, AjEasC, AjEasD, AjEasA, AjEasG, and AjEasH
EYS1851: AjDmaW_altC, AfEasF, AjEasE, AjEasC, AjEasD, AjEasA, and AjEasG Growth Conditions:

The engineered yeast strains EYS1849 and EYS1851 were grown in standard SC broth with 2% glucose (ForMedium, Hunstanton, U.K.). Cultures were grown with constant shaking at 20° C. for 72 hours in 250 mL shake flasks containing 25 mL medium.
Analytical Procedures:
Sample Preparation:
Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 µm 2.1×100 mm. Liquid Chromatography method: Mobile Phase A: $H_2O$+0.1% Formic Acid. Mobile Phase B: Acetonitrile+0.1% Formic Acid. Running conditions:

TABLE 17

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.
Preparative Procedures:
Sample Preparation:
Yeast cultures were spun down for 10 minutes at 1000×g. The pellet and the supernatant were separated. The supernatant was adjusted to pH=10 with 10 M NaOH and extracted by liquid/liquid extraction with an equal volume of Ethyl Acetate. The crude extract was dried under vacuum and reconstituted with Dimethyl Sulfoxide (DMSO) in order to obtain a concentration of 100 mg/mL. It was then purified on a preparative HPLC system (Waters, Milford, Mass., USA). Stationary Phase: Column was an XBridge™ preparative C18, 5 µm, 19×250 mm column.
Liquid Chromatography method: Mobile Phase A: $H_2O$+0.1% Trifluoroacetic Acid. Mobile Phase B: Acetonitrile+0.1% Trifluoroacetic Acid. Running conditions:

TABLE 18

| Time (min) | Flow (mL/min) | % mobile phase A | % mobile phase B |
|---|---|---|---|
| T = 0 | 14.00 | 99.0 | 1.0 |
| 41.50 | 14.00 | 70.0 | 30.0 |
| 42.00 | 14.00 | 0.0 | 100.0 |
| 46.00 | 14.00 | 0.0 | 100.0 |
| 46.10 | 14.00 | 99.0 | 1.0 |
| 56.00 | 14.00 | 99.0 | 1.0 |

ESI Parameters:
Source voltages: Capillary: 3.00 kV. Cone: 30 V. Extractor: 3 V. RF Lens: 0.1 V.
Source Temperature: 150° C. Desolvation temperature: 350° C.

Results:
EYS1849, EYS1851, and EYS1456 were grown at 20° C. as described above. The supernatants were analyzed by LC-MS and the extracted ion chromatogram of the expected mass of cycloclavine (m/z=239.1543+/−0.01 Da) of EYS1849 showed a peak with a retention time of 5.5 min. (+/−0.2) which was not seen in strain EYS1851 (nor in EYS1456, data not shown). Another conspicuous peak was present in EYS1849 and EYS1851 with a mass of m/z=241.1699+/−0.01 Da at a retention time of 5.91 min. (see FIG. 11).
The peak at retention time 5.49 min. was purified as described above and analyzed by LC-MS and NMR spectroscopy and the structure was elucidated, confirming the identity of the compound to be Cycloclavine.
The NMR data of purified compound eluted at 5.49 min. in the supernatant of EYS1849: $^1H$ NMR (600 MHz, CHLOROFORM-d) • ppm 0.70 (d, J=6.02 Hz, 1H) 1.72 (s, 3H) 1.81 (d, J=5.83 Hz, 1H) 2.83 (br. s., 3H) 3.02 (d, J=10.40 Hz, 1H) 3.09-3.17 (m, 1H) 3.27 (d, J=13.69 Hz, 1H) 3.63 (d, J=11.67 Hz, 1H) 3.99 (t, J=9.60 Hz, 1H) 6.76 (d, J=7.20 Hz, 1H) 6.88 (br. s., 1H) 7.05 (t, J=7.65 Hz, 1H) 7.19 (d, J=8.71 Hz, 1H) 11.79-12.55 (m, 1H).

Example 2: Production of Chanoclavine I in Baker's Yeast (*Saccharomyces cerevisiae*) Using *A. fumigatus* EasF, and *A. japonicus* DmaW_altC, EasE and EasC Materials and Methods:
The basic yeast strain EYS1456, used in these experiments, had the following genotype: CEN.PK 111-61A (MATα MAL2-8C SUC2 his3Δ1 leu2-3_112 ura3-52)
Gene Sequences:
The genes used in Example 2 are listed in Table 19.

TABLE 19

Genes used in Example 2

| Gene name | SEQ ID NO: | Source of sequence |
|---|---|---|
| AjDmaW_altC | 102 | *A. japonicus* |
| AfEasF | 107 | *A. fumigatus* |
| AjEasE | 106 | *A. japonicus* |
| AjEasC | 104 | *A. japonicus* |

Cloning of Genes:
Synthetic genes, codon optimized for expression in yeast, were manufactured. The genes encode the amino acid sequences (SEQ ID NO: 102, 107, 106 and 104) plus a translation stop codon. During synthesis all genes were provided, at the 5'-end, with the DNA sequence AAGCTAAA comprising a Hind III restriction recognition site, and at the 3'-end the DNA sequence CCGCGG comprising a Sac II recognition site. Genes were cloned, using Hind III and Sac II, into yeast expression cassettes (SEQ ID NO: 110 and 111) containing the native yeast promoters and terminators separated by a multiple cloning site comprising Hind III and Sac II. All cassettes were flanked by Asc I restriction sites. The gene expression cassettes (SEQ ID NO: 110 and 111) were comprised on a pUC18 based plasmid vector (SEQ ID NO: 112) into which a linker (SEQ ID NO: 113) had been inserted to provide an Asc I site for cloning of the expression cassettes.
Gene expression cassettes containing AjDmaW_altC (SEQ ID NO: 102) and AfEasF (SEQ ID NO: 107) were used for sub-cloning into an Integration Vector pEVE2294

(Seq ID No: 114), which also contained a yeast selectable marker gene (see Tables 16a and 16b). The two expression cassettes had the orientation head to head, meaning that promoters would allow transcription in opposite directions. The marker and expression cassette was flanked by sequences with homology to the genomic DNA of the host. The entire integration construct, comprising the expression cassettes and the selection marker, flanked by the genome homologous sequences, were released from the pUC18 based backbone by digestion with the Not I and Sbf I restriction enzymes and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target site for integration is described by Flagfeldt, 2009. The integration constructs and Seq IDs are listed in Table 16a and 16b (see example 1). The genes AjEasE (SEQ ID NO: 106) and AjEasC (SEQ ID NO: 104) were cloned into the PA and GC expression cassettes (SEQ ID NO: 110 and 111, respectively) and then inserted into the backbone of yeast vectors pRS315 and pRS313, respectively, to give the vectors pCCL254 and pCCL256. The pRS vectors pRS315 and pRS313 had already been modified by inserting the multi cloning site linker (SEQ ID NO:113) between the Pvu II sites of these original vectors, thus allowing cloning of the expression cassettes into the Asc I site of this linker. The pRS vectors are described by Sikorski, 1989.

Pathway Assembly:

A yeast strain was prepared by introducing, into EYS1456, a biosynthetic pathway for chanoclavine I. First, an intermediate strain was prepared by integrating the construct from pEVE2294 (SEQ ID NO: 114) into EYS1456 (see Table 16a and 16b in Example 1). The resulting strain was further transformed with both the empty vectors pRS315 and pRS313 to give CEY2871, or with the vectors pCCL254 and pCCL256 to give CEY3631. The two resulting strains, thus, contained the expression cassettes for the following genes:

CEY2871: AjDmaW_altC, and AfEasF

CEY3631: AjDmaW_altC, AfEasF, AjEasE, and AjEasC

Growth Conditions:

The engineered yeast strains CEY2871 and CEY3631 were grown in standard SC broth with 2% glucose, minus Leu (leucine) and His (histindine) (ForMedium, Hunstanton, U.K.). Cultures were grown with constant shaking at 30° C. for 72 hours in 250 mL shake flasks containing 25 mL medium.

Analytical Procedures:

Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA) coupled to a micrOTOF-Q II (Bruker Daltonik GmbH, Bremen, Germany). Stationary Phase: Column was an Acquity UPLC® Bridged Ethyl Hybrid (BEH) C18 1.7 µm 2.1×100 mm. Liquid Chromatography method: Mobile Phase A: H$_2$O+0.1% Formic Acid. Mobile Phase B: Acetonitrile+0.1% Formic Acid. Running conditions:

TABLE 20

| Time (min) | Flow (mL/min) | % mobile phase A | % mobile phase B |
|---|---|---|---|
| T = 0 | 0.400 | 99.0 | 1.0 |
| 5.00 | 0.400 | 0.0 | 100.0 |
| 6.00 | 0.400 | 0.0 | 100.0 |
| 6.10 | 0.400 | 99.0 | 1.0 |
| 7.50 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Preparative Procedures:

Sample Preparation:

Yeast cultures were spun down for 10 minutes at 1000×g. The pellet and the supernatant were separated. The supernatant was adjusted to pH=10 with 10 M NaOH and extracted by liquid/liquid extraction with an equal volume of Ethyl Acetate. The crude extract was dried under vacuum and reconstituted with Dimethyl Sulfoxide (DMSO) in order to obtain a concentration of 100 mg/mL. It was then purified on a preparative HPLC system (Waters, Milford, Mass., USA): Stationary Phase: Column was an XBridge™ preparative C18, 5 µm, 19×250 mm column.

Liquid Chromatography method: Mobile Phase A: H$_2$O+0.1% Trifluoroacetic Acid. Mobile Phase B: Acetonitrile+0.1% Trifluoroacetic Acid. Running conditions:

TABLE 21

| Time (min) | Flow (mL/min) | % mobile phase A | % mobile phase B |
|---|---|---|---|
| T = 0 | 14.00 | 99.0 | 1.0 |
| 21.00 | 14.00 | 70.0 | 50.0 |
| 27.00 | 14.00 | 0.0 | 100.0 |
| 31.00 | 14.00 | 0.0 | 100.0 |
| 31.10 | 14.00 | 99.0 | 1.0 |
| 41.00 | 14.00 | 99.0 | 1.0 |

ESI Parameters.

Source voltages: Capillary: 3.00 kV. Cone: 30 V. Extractor: 3 V. RF Lens: 0.1 V.

Source Temperature: 150° C. Desolvation temperature: 350° C.

Results:

The supernatants of CEY2871 and CEY3631 were analyzed by LC-MS. The extracted ion chromatogram of the expected mass of chanoclavine I (m/z=257.164+/−0.01 Da) showed a peak in the strain CEY3631 with a retention time of 4.4 min. (+/−0.2) which was not seen in strain CEY2871. (see FIG. 12)

The peak at retention time 4.4 min. was purified as described above and analyzed by LC-MS and NMR spectroscopy. The structure of the corresponding compound was elucidated, confirming the identity of the compound to be chanoclavine.

NMR data of the purified compound, eluted at 4.4 min.+/− 0.2 min, from CEY3631: $^1$H NMR (600 MHz, DMSO-d6) δ ppm 1.82 (s, 3H) 2.67 (t, J=5.22 Hz, 3H) 3.11 (dd, J=15.65, 7.79 Hz, 1H) 3.32 (dd, J=15.58, 4.00 Hz, 1H) 3.54 (m, J=7.20, 3.60, 3.60 Hz, 1H) 3.95 (s, 2H) 4.25 (dd, J=9.39, 7.60 Hz, 1H) 5.36 (dd, J=9.74, 0.89 Hz, 1H) 6.71 (d, J=7.11

Hz, 1H) 7.08 (t, J=7.60 Hz, 1H) 7.16 (s, 1H) 7.25 (d, J=8.09 Hz, 1H) 8.48 (br. s., 1H) 8.73 (br. s., 1H) 11.01 (s, 1H)

Example 3: Production of Chanoclavine I Using EasF from *A. fumigatus*, DmaW_altC and EasC from *A. japonicus*, and Either EasE or SUMO-EasE from *A. japonicus*

Materials and Methods:

The basic yeast strain EYS1456, used in these experiments, had the following genotype: CEN.PK 111-61A (MATα MAL2-8C SUC2 his3Δ1 leu2-3_112 ura3-52)

Gene Sequences:

The genes used in Example 3 are listed in Table 22.

TABLE 22

Genese used in Example 3

| Gene name | Seq. ID | Source of sequence |
| --- | --- | --- |
| AjDmaW_altC | 102 | *A. japonicus* |
| AfEasF | 107 | *A. fumigatus* |
| AjEasE | 106 | *A. japonicus* |
| AjEasE_SUMO | 119 | *A. japonicus* |
| AjEasC | 104 | *A. japonicus* |

Cloning of Genes:

Synthetic genes, codon optimized for expression in yeast, were manufactured. The genes encode the amino acid sequences (SEQ ID NO: 102, 107, 106, 119 and 104) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (SEQ ID NO: 110 and 111) containing the native yeast promoters and terminators separated by a multiple cloning site comprising Hind III and Sac II. All cassettes were flanked by Asc I restriction sites. The gene expression cassettes (SEQ ID NO: 110 and 111) were comprised on a pUC18 based plasmid vector (SEQ ID NO: 112) into which a linker (SEQ ID NO: 113) had been inserted to provide an Asc I site for cloning of the expression cassettes.

Gene expression cassettes containing AjDmaW_altC SEQ ID NO: 102) and AfEasF (SEQ ID NO: 107) were used for sub-cloning into an Integration Vector pEVE2294 (SEQ ID NO: 114), which also contained a yeast selectable marker gene (see Table 16a and 16b in Example 1). The two expression cassettes had the orientation head to head, meaning that promoters would allow transcription in opposite directions. The marker and expression cassette was flanked by sequences with homology to the genomic DNA of the host. The entire integration construct, comprising the expression cassettes and the selection marker, flanked by the genome homologous sequences, were released from the pUC18 based backbone by digestion with the Not I and Sbf I restriction enzymes and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target site for integration is described by Flagfeldt, 2009. The integration constructs and Seq. IDs are listed in Table 16a and 16b (see Example 1).

The genes AjEasE (SEQ ID NO: 106) and AjEasC (SEQ ID NO:104) were cloned into the PA and GC expression cassettes (SEQ ID NO: 110 and 111, respectively) and then inserted into the backbone of yeast vectors pRS315 and pRS313, respectively, to give the vectors pCCL254 and pCCL256. The vector pCCL255 was created by inserting, into the unique Hind III site of vector pCCL254, a synthetic DNA sequence containing a SUMO-tag, thus creating an N-terminally SUMOylated version of the EasE enzyme (SEQ ID NO: 119). Use of SUMO-tags is described by e.g. Peroutka, 2008.

The pRS vectors pRS315 and pRS313 had already been modified by inserting the multi cloning site linker (SEQ ID NO: 113) between the Pvu II sites of these original vectors, thus allowing cloning of the expression cassettes into the Asc I site of this linker. The pRS vectors are described by Sikorski, 1989.

Pathway Assembly:

Yeast strains were prepared by introducing, into EYS1456, a biosynthetic pathway for chanoclavine I. An intermediate strain was prepared by integrating the construct from pEVE2294 (SEQ ID NO: 114) into EYS1456. The resulting strain was further transformed with the vectors pCCL254 and pCCL256 to give CEY3631, or with the vectors pCCL254 and pCCL255 to give CEY3645. The two resulting strains, thus, contained the expression cassettes for the following genes:

CEY3631: AjDmaW_altC, AfEasF, AjEasE, and AjEasC
CEY3645: AjDmaW_altC, AfEasF, SUMO-AjEasE, and AjEasC Growth Conditions:

The engineered yeast strains CEY3631 and CEY3645 were grown in standard SC broth with 2% glucose, minus Leu and His (ForMedium, Hunstanton, U.K.). Cultures were grown with constant shaking at 30° C. for 72 hours in 250 mL shake flasks containing 25 mL medium.

Analytical Procedures:

Sample Preparation:

Yeast cultures were spun down for 10 minutes at 1000×g. The pellet and the supernatant were separated. Without further purification 5 μL of supernatant were injected in a UPLC-TOF (Waters Acquity™ Ultra Performance LC, Waters, Milford, Mass., USA, coupled to a micrOTOF-Q II, Bruker Daltonik GmbH, Bremen, Germany. Stationary Phase: Column was an Acquity UPLC® Bridged Ethyl Hybrid (BEH) C18 1.7 μm 2.1×100 mm. Liquid Chromatography method: Mobile Phase A: $H_2O$+0.1% Formic Acid. Mobile Phase B: Acetonitrile+0.1% Formic Acid. Running conditions:

TABLE 23

| Time (min) | Flow (mL/min) | % mobile phase A | % mobile phase B |
| --- | --- | --- | --- |
| T = 0 | 0.400 | 99.0 | 1.0 |
| 5.00 | 0.400 | 0.0 | 100.0 |
| 6.00 | 0.400 | 0.0 | 100.0 |
| 6.10 | 0.400 | 99.0 | 1.0 |
| 7.50 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The supernatants of CEY3631, and CEY3645 were analyzed by LC-MS. The mass of chanoclavine I (m/z=257.164+/−0.01 Da) was extracted from the TIC (Total Ion Chromatogram). A peak was detected with a retention time of 2.0 min. (+/−0.1) corresponding to the previously (see example 2) elucidated chanoclavine I (see FIG. 13).

The area under the peak corresponding to chanoclavine I was integrated, which showed an approximately 27% increase in the strain that had a SUMOylated version of EasE (CEY3645) compared to the strain with a non-SUMOylated version (CEY3631), see FIG. 13, insert.

Example 4: Production of Me-DMAT Using AjDmaW_altC in Combination with EasF from *A. fumigatus* or *A. japonicus*

Materials and Methods:

The basic yeast strain EYS1456, used in these experiments, had the following genotype: CEN.PK 111-61A (MATα MAL2-8C SUC2 his3Δ1 leu2-3_112 ura3-52)

Gene Used in Example 4 are Listed in Table 24:

TABLE 24

Genes used in Example 4

| Gene name | Seq. ID | Source of sequence |
|---|---|---|
| AjDmaW_altC | 102 | A. japonicus |
| AfEasF | 107 | A. fumigatus |
| AjEasF | 120 | A. japonicus |

Cloning of Genes:

Synthetic genes, codon optimized for expression in yeast. The genes encode the amino acid sequences (SEQ ID NO: 102, 107 and 120) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast CA expression cassette (SEQ ID NO: 121) containing the native yeast Cup1 promoter and Adh1 terminator separated by a multiple cloning site comprising Hind III and Sac II. All cassettes were flanked by Asc I restriction sites. The gene expression cassette (SEQ ID NO: 121) was comprised on a pUC18 based plasmid vector (SEQ ID NO: 112) into which a linker SEQ ID NO: 113) had been inserted to provide an Asc I site for cloning of the expression cassettes.

The gene AjDmaW_altC (Seq ID No: 102) was cloned into the CA expression cassette (SEQ ID NO: 121) and then inserted into the backbone of yeast vector pRS316 to give the vector pCCL100. The genes AfEasF (Seq ID No: 107) and AjEasF (Seq ID No: 120) were cloned into the CA expression cassette (SEQ ID NO: 121) and then individually inserted into the backbone of yeast vector pRS315 to give the vectors pCCL98 and pCCL91, respectively. The pRS vectors pRS316 and pRS315 had already been modified by inserting the multi cloning site linker (SEQ ID NO: 113) between the Pvu II sites of these original vectors, thus allowing cloning of the expression cassettes into the Asc I site of this linker. The pRS vectors are described by Sikorski, 1989.

Pathway Assembly:

Yeast strains were prepared by introducing, into EYS1456, a biosynthetic pathway for Me-DMAT. EYS1456 was transformed either with the vectors pCCL100 and pCCL98 to give CEY2557, or the vectors pCCL100 and pCCL91 to give CEY2625. The two resulting strains, thus, contained the expression cassettes for the following genes:

CEY2557: AjDmaW_altC and AjEasF
CEY2625: AjDmaW_altC and AfEasF

Growth Conditions:

The engineered yeast strains CEY2557 and CEY2625 were grown in standard SC broth with 2% glucose, minus Leu (leucine) and Ura (uracil) (ForMedium, Hunstanton, U.K.). Copper sulphate was added to a final concentration of 200 µM. Cultures were grown with constant shaking at 30° C. for 72 hours in 250 mL shake flasks containing 25 mL medium.

Analytical Procedures:
Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA, coupled to a micrOTOF-Q II, Bruker Daltonik GmbH, Bremen, Germany. Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 25

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Preparative Procedures:
Sample Preparation:

Yeast cultures were spun down for 10 minutes at 1000×g. The pellet and the supernatant were separated. The supernatant was adjusted to pH=10 with 10 M NaOH and extracted by liquid/liquid extraction with an equal volume of Ethyl Acetate. The crude extract was dried under vacuum and reconstituted with Dimethyl Sulfoxide (DMSO) in order to obtain a concentration of 100 mg/mL. It was then purified on a preparative HPLC system (Waters, Milford, Mass., USA): Stationary Phase: Column was an XBridge™ preparative C18, 5 µm, 19×250 mm column.

Liquid Chromatography method: Mobile Phase A: $H_2O$+0.1% Trifluoroacetic Acid. Mobile Phase B: Acetonitrile+0.1% Trifluoroacetic Acid. Running conditions:

TABLE 26

| Time (min) | Flow (mL/min) | % mobile phase A | % mobile phase B |
|---|---|---|---|
| T = 0 | 14.00 | 99.0 | 1.0 |
| 21.00 | 14.00 | 70.0 | 50.0 |

TABLE 26-continued

| Time (min) | Flow (mL/min) | % mobile phase A | % mobile phase B |
|---|---|---|---|
| 27.00 | 14.00 | 0.0 | 100.0 |
| 31.00 | 14.00 | 0.0 | 100.0 |
| 31.10 | 14.00 | 99.0 | 1.0 |
| 41.00 | 14.00 | 99.0 | 1.0 |

ESI Parameters:

Source voltages: Capillary: 3.00 kV. Cone: 30 V. Extractor: 3 V. RF Lens: 0.1 V.

Source Temperature: 150° C. Desolvation temperature: 350° C.

Results:

The supernatants of CEY2557 and CEY2625 were analyzed by LC-MS. The extracted ion chromatograms of the expected mass of Me-DMAT (m/z=287.175+/−0.01 Da) showed a peak at retention time 7.8+/−0.2 min. (see FIG. 14). This peak was purified as described above and analyzed by LC-MS and NMR spectroscopy and the structure was elucidated confirming the identity of the compound to be Me-DMAT.

The area under the peak corresponding to Me-DMAT was integrated, which showed a more than two fold increase in the strain that had the *A. fumigatus* version of EasF (CEY2625) compared to the strain with the *A. japonicus* version (CEY2557), see FIG. 15.

Me-DMAT; NMR data of purified compound eluted at 5.49 min. in the supernatant of CEY2557: 1H NMR (600 MHz, DMSO-d6) δ ppm 1.61 (s, 3H) 1.63 (s, 3H) 2.45 (s, 3H) 3.19 (dd, J=16.28, 8.33 Hz, 1H) 3.42 (dd, J=16.00, 4.94 Hz, 1H) 3.57-3.63 (m, 3H) 5.13-5.21 (m, 1H) 6.74 (d, J=7.15 Hz, 1H) 6.98 (t, J=7.50 Hz, 1H) 7.14 (s, 1H) 7.16-7.21 (m, 1H)

Example 5: Production of Me-DMAT Using EasF from *A. fumigatus* Together with CpDmaW, AjDmaW_altC, or AjDmaW_trcC Materials and Methods:

The basic yeast strain EYS1456, used in these experiments, had the following genotype: CEN.PK 111-61A (MATα MAL2-8C SUC2 his3Δ1 leu2-3_112 ura3-52)

Genes Used in Example 5 are Listed in Table 27:

TABLE 27

Genes used in Example 5

| Gene name | Seq. ID | Source of sequence |
|---|---|---|
| AjDmaW_altC | 102 | *A. japonicus* |
| AjDmaW_trcC | 122 | *A. japonicus* |
| CpDmaW | 123 | *C. purpurea* |
| AfEasF | 107 | *A. fumigatus* |

Cloning of Genes:

Synthetic genes, codon optimized for expression in yeast. The genes encode the amino acid sequences (SEQ ID NO: 102 to 107 and SEQ ID NO: 122 to 123) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into the yeast CA expression cassette (SEQ ID NO: 121) containing the native yeast Cup1 promoter and Adh1 terminator separated by a multiple cloning site comprising Hind III and Sac II. All cassettes were flanked by Asc I restriction sites. The gene expression cassette (SEQ ID NO: 121) was comprised on a pUC18 based plasmid vector (SEQ ID NO: 112) into which a linker (SEQ ID NO: 113) had been inserted to provide an Asc I site for cloning of the expression cassettes.

The genes AjDmaW_altC (SEQ ID NO: 102), AjDmaW_trcC (SEQ ID NO: 122) and CpDmaW (SEQ ID NO: 123) were cloned into the CA expression cassette (SEQ ID NO: 121) and then inserted into the backbone of yeast vectors pRS316 to give the vectors pCCL100, pCCL99, and pCCL95, respectively. The gene AfEasF was cloned into the CA expression cassette (SEQ ID NO: 121) and then inserted into the backbone of yeast vector pRS315 to give the vector pCCL98. The pRS vectors pRS316 and pRS315 had already been modified by inserting the multi cloning site linker (SEQ ID NO: 113) between the Pvu II sites of these original vectors, thus allowing cloning of the expression cassettes into the Asc I site of this linker. The pRS vectors are described by Sikorski, 1989.

Pathway Assembly:

Yeast strains were prepared by introducing, into EYS1456, a biosynthetic pathway for Me-DMAT. EYS1456 was transformed either with the vectors pCCL100 and pCCL98 to give CEY2557, or the vectors pCCL99 and pCCL98 to give CEY2563, or the vectors pCCL95 and pCCL98 to give CEY2575. The three resulting strains, thus, contained the expression cassettes for the following genes:

CEY2557: AjDmaW_altC and AfEasF
CEY2563: AjDmaW_trcC and AfEasF
CEY2575: CpDmaW and AfEasF Growth Conditions:

The engineered yeast strains CEY2557, CEY2563, and CEY2575 were grown in standard SC broth with 2% glucose, minus Leu (leucine) and Ura (uracil) (ForMedium, Hunstanton, U.K.). Copper sulphate was added to a final concentration of 200 μM. Cultures were grown with constant shaking at 30° C. for 72 hours in 250 mL shake flasks containing 25 mL medium.

Analytical Procedures:

Sample Preparation:

Yeast cultures were spun down for 10 minutes at 1000×g. The pellet and the supernatant were separated. Without further purification 5 μL of supernatant were injected in a UPLC-TOF (Waters Acquity™ Ultra Performance LC, Waters, Milford, Mass., USA, coupled to a micrOTOF-Q II, Bruker Daltonik GmbH, Bremen, Germany. Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 28

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V.

Nebulizer: 1.6 bar. Dry Gas: 8.0 L/min. Dry Temperature: 180° C. Scan mode: MS Scan. Mass range: from 80 to 1000 m/z.

Preparative Procedures:

Sample Preparation:

Yeast cultures were spun down for 10 minutes at 1000×g. The pellet and the supernatant were separated. The supernatant was adjusted to pH=10 with 10 M NaOH and extracted by liquid/liquid extraction with an equal volume of Ethyl Acetate. The crude extract was dried under vacuum and reconstituted with Dimethyl Sulfoxide (DMSO) in order to obtain a concentration of 100 mg/mL. It was then purified on a preparative HPLC system (Waters, Milford, Mass., USA): Stationary Phase: Column was an XBridge™ preparative C18, 5 µm, 19×250 mm column.

Liquid Chromatography method: Mobile Phase A: $H_2O$+ 0.1% Trifluoroacetic Acid. Mobile Phase B: Acetonitrile+ 0.1% Trifluoroacetic Acid. Running conditions:

TABLE 29

| Time (min) | Flow (mL/min) | % mobile phase A | % mobile phase B |
|---|---|---|---|
| T = 0 | 14.00 | 99.0 | 1.0 |
| 21.00 | 14.00 | 70.0 | 50.0 |
| 27.00 | 14.00 | 0.0 | 100.0 |
| 31.00 | 14.00 | 0.0 | 100.0 |
| 31.10 | 14.00 | 99.0 | 1.0 |
| 41.00 | 14.00 | 99.0 | 1.0 |

ESI Parameters:

Source voltages: Capillary: 3.00 kV. Cone: 30 V. Extractor: 3 V. RF Lens: 0.1 V.

Source Temperature: 150° C. Desolvation temperature: 350° C.

Results:

The supernatants of CEY2557, CEY2563, and CEY2575 were analyzed by LC-MS. The extracted ion chromatograms of the peaks indicated a compound with the expected mass of Me-DMAT (m/z=257.164+/−0.01 Da) (see FIG. 16). This peak, at retention time 7.8 min., was purified as described above and analyzed by LC-MS and NMR spectroscopy and the structure was elucidated, confirming the identity of the compound to be Me-DMAT. (The area under the peak, corresponding to Me-DMAT, was integrated (FIG. 16, insert) showing a similar level of Me-DMAT production for all three strains.

Example 6: Production of Me-DMAT Using DmaW_altC from *A. japonicus* and EasF from *A. Fumigatus* in a Host Strain with Reduced Farnesyl Pyrophosphate Synthase Activity Materials and Methods:

The basic yeast strain EYS1456, used in these experiments, had the following genotype: CEN.PK 111-61A (MATα MAL2-8C SUC2 his3Δ1 leu2-3_112 ura3-52)

Genes Used in Example 6 are Listed in Table 30:

TABLE 30

| Genes used in Example 6 | | |
|---|---|---|
| Gene name | Seq. ID | Source of sequence |
| AjDmaW_altC | 102 | *A. japonicus* |
| AfEasF | 107 | *A. fumigatus* |

Cloning of Genes:

Synthetic genes, codon optimized for expression in yeast, were manufactured by GeneArt AG, Regensburg, Germany. The genes encode the amino acid sequences (SEQ ID NO: 102 and 107) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. AjDmaW (SEQ ID NO: 102) was cloned, using Hind III and Sac II, into the yeast PA expression cassette (SEQ ID NO: 110) containing the native yeast Pgk1 promoter and Adh2 terminator separated by a multiple cloning site comprising Hind III and Sac II. AfEasF was cloned, using Hind III and Sac II, into the yeast TE expression cassette (SEQ ID NO: 124) containing the native yeast Tef1 promoter and Eno2 terminator separated by a multiple cloning site comprising Hind III and Sac II. Both cassettes were flanked by Asc I restriction sites. The gene expression cassettes (SEQ ID NO: 110 and 124) were comprised on a pUC18 based plasmid vector (SEQ ID NO: 112) into which a linker (SEQ ID NO: 113) had been inserted to provide an Asc I site for cloning of the expression cassettes.

The genes AjDmaW and AfEasF were then cloned into a single 2 µM vector based on the vector pESC-Ura (Agilent Technologies (Schweiz) AG, Basel, Switzerland): The Bgl II/Sac II fragment of the PA expression cassette, comprising the Pgk1 promoter and the AfEasF coding sequence, was inserted into pESC-Ura digested with Bgl II and Sac II. This replaces the Adh2 terminator with the Cyc1 terminator of the pESC-Ura. The resulting vector was digested with Bgl II and Sac I, and the vector backbone was ligated to a similarly digested PCR product comprising the Tef1 promoter from the TE expression cassette. The PCR product had been prepared with PCR primers incorporating a Bgl II site at the 5'-end, and the three sites Aar I, Pme I, and Sac I at the 3'-end. Finally, the resulting vector was digested with Aar I and Pme I. The Aar I had been designed to leave an overhang compatible with a Bgl II digested sequence, and Pme I leaves a blunt end. The TE expression cassette with AjDmaW_altC was then digested with Sac II, which was made blunt using T4 DNA polymerase, and subsequently with Bgl II. This fragment, comprising the Tef 1 promoter and the AjDmaW_altC coding sequence was then ligated to the backbone, digested with Aar I and Pme I as just described. This replaces the Eno2 terminator with the Adh1 terminator of the pESC-Ura. The final vector, named pEVE2075 (SEQ ID NO: 125) contains the AjDmaW between the Tef1 promoter and the Adh1 terminator, and the AfEasF between the Pgk1 promoter and the Cyc1 terminator.

Preparation of a Yeast Host with Reduced ERG20 Activity:

The yeast strain EYS1456 was modified by deleting part of the ERG20 regulatory region and replacing it with the relatively weak constitutive native promoter of the ScKex2 gene. First, the vector pEVE2049 SEQ ID NO: 126) was prepared, which comprises a selectable nourseothricin resistance marker gene NatR, followed by the ScKex2 promoter. The NatR-ScKex2 fragment was then amplified by PCR, using the two primers SEQ ID NO: 127 and 128. The 5'-end of SEQ ID NO: 127 is identical to the genomic sequence of the yeast host at position −768 to −724 relative to the ERG20 translation start site (HR1 in FIG. 17), and the 3'-end is identical to a sequence in pEVE2049 upstream of the NatR selectable marker. The 5'-end of SEQ ID NO: 128 is identical to the reverse complement sequence of the ERG20 coding sequence (HR2 in FIG. 17), and the 3'-end is identical to the reverse complement sequence of the 3'-end of the ScKex2 promoter. The PCR product was used to transform EYS1456, resulting in the displacement of the ERG20 promoter region with the ScKEX2 promoter. A clone with successful integration was selected for by use of the NatR selectable marker. FIG. 17 shows an outline of the integration construct and the genomic target region. This clone, and EYS1456, was further transformed with the plasmid pEVE2075 to create strains EYS1538 (control strain with native ERG20 promoter region) and EYS1926, which had the native ERG20 promoter replaced by the ScKex2 promoter.

Pathway Assembly:

Two yeast strains, EYS1538 and EYS1926, carrying the plasmid pEVE2075 were prepared as described above, creating in both the biosynthetic pathway for Me-DMAT. The resulting strains, thus, both contained the expression cassettes for the following genes: EYS1538 and EYS1926: AjDmaW_altC and AfEasF Growth Conditions:

The engineered yeast strains EYS1538 and EYS1926 were grown in standard SC broth with 2% glucose, minus Ura (Uracil) (ForMedium, Hunstanton, U.K.). Cultures were grown with constant shaking at 30° C. for 72 hours in 250 mL shake flasks containing 25 mL medium.

Analytical Procedures:

Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA, coupled to a micrOTOF-Q II, Bruker Daltonik GmbH, Bremen, Germany. Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 31

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The supernatants of EYS1538 and EYS1926 were analyzed by LC-MS. The extracted ion chromatograms indicated a peak corresponding to the expected mass of Me-DMAT (m/z=257.164+/−0.01 Da) at retention time 7.8 min. The peak was identified as Me-DMAT by reference to the compound previously purified (see Example 4). The area under the peaks, corresponding to Me-DMAT, was integrated showing a more than two fold increase of Me-DMAT in EYS1926 as compared to EYS1538 (See FIG. 18). This increase was ascribed to the promoter replacement in EYS1926, which leads to ERG20 down regulation and, hence, increased availability of DMAPP for Me-DMAT synthesis.

Example 7: Production of Cycloclavine in Baker's Yeast (Saccharomyces cerevisiae) by Expressing an Eight Step Heterologous Pathway, Including P. divaricatus EasH Materials and Methods:

The basic yeast strain EYS1456, used in these experiments, had the following genotype: CEN.PK 111-61A (MATα MAL2-8C SUC2 his3Δ1 leu2-3_112 ura3-52) Genes Used in Example 7 are Listed in Table 32:

TABLE 32

List of genes used in Example 7

| Gene name | Seq. ID | Source of sequence |
|---|---|---|
| Aj_DmaW_altC | 102 | A. japonicus |
| Af_EasF | 107 | A. fumigatus |
| Aj_EasE | 106 | A. japonicus |
| Aj_EasC | 104 | A. japonicus |
| Aj_EasD | 105 | A. japonicus |
| Aj_EasH | 109 | A. japonicus |
| Pd_EasH | 157 | P. divaricatus |
| Aj_EasA | 103 | A. japonicus |
| Aj_EasG | 108 | A. japonicus |

Cloning of Genes:

Synthetic genes, codon optimized for expression in yeast, were manufactured by DNA2.0 Inc., Menlo Park, Calif., USA or GeneArt AG, Regensburg, Germany. The genes encode the amino acid sequences (Seq ID No:102 to 109 and 157) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (Seq ID No:110 and 111) containing the native yeast promoters and terminators separated by a multiple cloning site comprising Hind III and Sac II. All cassettes were flanked by Asc I restriction sites. The gene expression cassettes (Seq ID No: 110 and 111) were comprised on a pUC18 based plasmid vector (Seq ID No: 112) into which a linker (Seq ID No: 113) had been inserted to provide an Asc I site for further cloning of the expression cassettes.

Gene expression cassettes were used for sub-cloning either one or two cassettes into designated Integration Vectors (Seq ID No: 114 to 118), which also contained a yeast selectable marker gene. In the case of two expression cassettes the orientation of cloning was head to head, meaning that promoters would allow transcription in opposite directions. The marker and expression cassette(s) were flanked by sequences with homology to the genomic DNA of the host (Seq ID No: 114 to 118). The entire integration constructs, comprising the expression cassette(s) and selection marker, flanked by the homologous sequences, were released from the pUC18 based backbone by digesting the Integration Vectors with the Sbf I restriction enzyme, and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target sites for integration are described by Flagfeldt, 2009. Seq ID Nos of the Integration Vectors and their integration constructs are listed in Table 33.

TABLE 33

Integration Vectors and their integration constructs used in Example 7

| Construc name | SEQ ID No: | Cassette 1 | | | Cassette 2 | | | Marker | Dest. region |
|---|---|---|---|---|---|---|---|---|---|
| | | Prom. | Gene | Term. | Prom. | Gene | Term | | |
| pEVE2294 | 114 | ScPgK1 | AfEasF | ScAdh1 | ScGpd1 | AjDmaW_altC | ScCyc1 | KanMX | YorWΔ17 |
| pEVE2312 | 115 | ScPgK1 | AjEasC | ScAdh1 | ScGpd1 | AjEasE | ScCyc1 | HygR | YPRCΔ15 |
| pEVE2342 | 116 | ScPgK1 | AjEasD | ScAdh1 | | | | BleR | YORWΔ22 |
| pEVE2344 | 118 | ScPgK1 | AjEasA | ScAdh1 | ScGpd1 | AjEasG | ScCyc1 | NatR | YPRC₇3 |

In addition, two plasmids were constructed containing either the AjEasH gene from *Aspergillus japonicus* (Seq ID No: 109) or the PdEasH gene from *Paecilomyces divaricatus* (Seq ID 028), cloned into a pRS315 vector equipped with the expression cassette (Seq ID No: 111), which uses the GPD1 promoter and the CYC1 terminator. Cloning was done as described in Example 2.

Pathway Assembly:

A yeast strain, EYS1851, was prepared by integrating, into EYS1456, the constructs from pEVE2294, pEVE2312, pEVE2342, and pEVE2344 (Table 33). Two strains, EYS2098 and EYS2099, were prepared by transforming EYS1851 with the pRS vectors (see above) containing the PdEasH or the AjEasH, respectively. The resulting strains thus contained the expression cassettes for the following genes:

EYS2098: AjDmaW_altC, AfEasF, AjEasE, AjEasC, AjEasD, AjEasA, AjEasG, PdEasH
EYS2099: AjDmaW_altC, AfEasF, AjEasE, AjEasC, AjEasD, AjEasA, AjEasG, AjEasH Growth Conditions:

The engineered yeast strains EYS2098 and EYS2099 were grown in standard SC broth with 2% glucose (ForMedium, Hunstanton, U.K.) minus leucine. Cultures were grown with constant shaking at 20° C. for 72 hours in 250 mL shake flasks containing 25 mL medium.

Analytical Procedures:

Sample Preparation:

Yeast cultures were spun down for 10 minutes at 1000×g. The pellet and the supernatant were separated. Without further purification 5 μL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 34

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The supernatants from EYS2098 and EYS2099 were analyzed by LC-MS, and production of chanoclavine I (trace amounts) and cycloclavine was verified by reference to pure compounds (see Examples 1 and 2 for compound identification). Production of cycloclavine in both strains (see FIG. 19) shows the ability of the EasH genes, both from *P. divaricatus* or *A. japonicus*, to confer the production of this compound, since no cycloclavine is produced by the parental strain EYS1851 (see Example 1).

Example 8: Increased Production of Me-DMAT, Using DmaW_altC from *A. japonicus* and EasF from *A. fumigatus*, in a Host Strain with Increased Isopentenyl Diphosphate: Dimethylallyl Diphosphate Isomerase Activity (Idi1)

Materials and Methods:

The basic yeast strain EYS1456, used in these experiments, had the following genotype: CEN.PK 111-61A (MATα MAL2-8C SUC2 his3Δ1 leu2-3_112 ura3-52) Genes Used in Example 8 are Listed in Table 35:

TABLE 35

Genes used in Example 8

| Gene name | Seq. ID No: | Source of sequence |
|---|---|---|
| AjDmaW_altC | 102 | *A. japonicus* |
| AfEasF | 107 | *A. fumigatus* |
| ScIdi1 | 158 | *S. cerevisiae* |

Cloning of Genes:

Two synthetic genes, codon optimized for expression in yeast, were manufactured by GeneArt AG, Regensburg, Germany, encoding the amino acid sequences of AjDmaW_altC (Seq ID No: 102) and AfEasF (Seq ID No: 107) including a translation stop codon. The gene encoding the ScIdi1 (isopentenyl diphosphate:dimethylallyl diphosphate isomerase) (Seq ID No: 158) was amplified by PCR using genomic DNA from *S. cerevisiae* as template. During synthesis (AjDmaW_altC and AfEasF), or PCR amplification (ScIdi1), all genes were provided, at the 5'-end, with the DNA sequence AAGCTTAAA comprising a Hind III restriction recognition site, and at the 3'-end the DNA sequence CCGCGG comprising a Sac II recognition site.

Genes were cloned, using Hind III and Sac II, into yeast expression cassettes (Seq ID No: 110, 124 and 159) containing native yeast promoters (Gpd1, Tef1, and Tef2 respectively) and terminators (Cyc1, Eno2, and Pgi1 respectively), separated by a multiple cloning site comprising Hind III and Sac II. All cassettes were flanked by Asc I restriction sites. The gene expression cassettes were comprised on a pUC18 based plasmid vector (Seq ID No: 112) into which a linker (Seq ID No: 113) had been inserted to provide an Asc I site for cloning of the expression cassettes. Finally, the expression cassettes containing the genes were cloned as an Asc I fragment, into the backbone of yeast vectors pRS316, pRS315 and pRS313, respectively. The pRS vectors pRS316, pRS315 and pRS313 had already been modified by inserting the multi cloning site linker (Seq ID No: 113) between the Pvu II sites of these original vectors, thus allowing cloning of the expression cassettes into the Asc I site of this linker. The pRS vectors are described by Sikorski, 1989.

Pathway Assembly:

A yeast strain, EYS2055, was prepared by introducing into EYS1456, a biosynthetic pathway for Me-DMAT, using the pRS vectors described above comprising the genes AjDmaW_altC and AfEasF. This strain was further transformed with the third pRS vector, comprising the ScIdi1 gene, to create strain EYS2056. The two resulting strains, thus, contained the expression cassettes for the following genes:

EYS2055: AjDmaW_altC, and AfEasF
EYS2056: AjDmaW_altC, AfEasF, and ScIdi1

Growth Conditions:

The engineered yeast strains EYS2055 and EYS2056 were grown in standard SC broth with 2% glucose, minus His (histidine), Leu (leucine) and Ura (uracil) (ForMedium, Hunstanton, U.K.). Cultures were grown with constant shaking at 20° C. or 30° C. for 72 hours in 250 mL shake flasks containing 25 mL medium.

Analytical Procedures:
Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA, coupled to a micrOTOF-Q II, Bruker Daltonik GmbH, Bremen, Germany. Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 36

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The supernatants of EYS2055 and EYS2056 were analyzed by LC-MS. The ion chromatograms of the expected masses of DMAT (m/z=273.159+/−0.01 Da) and Me-DMAT (m/z=287.175+/−0.01 Da) were extracted, and the area under the peaks was integrated. The results (see FIGS. 20a and 20b) showed, at both temperatures, an increase in Me-DMAT production in strain EYS2056 as compared to EYS2055. The increase corresponded to the overexpression of ScIdi1, as compared to the normal wild type expression levels of EYS2055

Example 9: Increased Production of Cycloclavine by Expressing an Additional Copy of a Gene of the Full Length Heterologous Pathway Materials and Methods:

The basic yeast strain EYS1456, used in these experiments, had the following genotype: CEN.PK 111-61A (MATα MAL2-8C SUC2 his3Δ1 leu2-3_112 ura3-52)

Genes Used in Example 9 are Listed in Table 37:

TABLE 37

List of genes used in Example 9

| Gene name | Seq. ID No: | Source of sequence |
|---|---|---|
| Aj_DmaW_altC | 102 | A. japonicus |
| Af_EasF | 107 | A. fumigatus |
| Aj_EasE | 106 | A. japonicus |
| Aj_EasC | 104 | A. japonicus |
| Aj_EasD | 105 | A. japonicus |
| Aj_EasH | 109 | A. japonicus |
| Aj_EasA | 103 | A. japonicus |
| Aj_EasG | 108 | A. japonicus |

Cloning of Genes:

Synthetic genes, codon optimized for expression in yeast, were manufactured by DNA2.0 Inc., Menlo Park, Calif., USA or GeneArt AG, Regensburg, Germany. The genes encode the amino acid sequences (Seq ID No: 102 to 109) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (Seq ID No: 110 and 111) containing native yeast promoters and terminators separated by a multiple cloning site comprising Hind III and Sac II. All cassettes were flanked by Asc I restriction sites. The gene expression cassettes (Seq ID No: 110 and 111) were comprised on a pUC18 based plasmid vector (Seq ID No: 112) into which a linker (Seq ID No: 113) had been inserted to provide an Asc I site for cloning of the expression cassettes.

Gene expression cassettes were used for sub-cloning one or two cassettes into designated Integration Vectors (Seq ID No: 114, 115, 117, 118 and 160), which also contained a yeast selectable marker gene. The orientation of cloning was head to head, meaning that promoters would allow transcription in opposite directions. The marker and expression cassette(s) were flanked by sequences with homology to the genomic DNA of the host. The final integration constructs (Seq ID No: 114, 115, 117, 118 and 160), comprising the expression cassette(s) and selection marker, flanked by the homologous sequences, were released from the pUC18 based backbone by digesting the Integration Vectors with the Sbf I restriction enzyme, and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target sites for integration are described by Flagfeldt, 2009. Seq ID Nos of the Integration Vectors and their integration constructs are listed in Table 38.

TABLE 38

Integration Vectors and their integration constructs used in Example 9

| Construc name | SEQ ID No: | Cassette 1 | | | Cassette 2 | | | Marker | Dest. region |
|---|---|---|---|---|---|---|---|---|---|
| | | Prom. | Gene | Term. | Prom. | Gene | Term | | |
| pEVE2294 | 114 | ScPgK1 | AfEasF | ScAdh1 | ScGpd1 | AjDmaW_altC | ScCyc1 | KanMX | YorWΔ17 |
| pEVE2312 | 115 | ScPgK1 | AjEasC | ScAdh1 | ScGpd1 | AjEasE | ScCyc1 | HygR | YPRCΔ15 |
| pEVE2343 | 117 | ScPgK1 | AjEasD | ScAdh1 | ScGpd1 | AjEasH | ScCyc1 | BleR | YORWΔ22 |
| pEVE2344 | 118 | ScPgK1 | AjEasA | ScAdh1 | ScGpd1 | AjEasG | ScCyc1 | NatR | YPRC$_T$3 |
| pEVE2656 | 160 | ScGpd1 | AjEasC | ScCyc1 | | | | KanMX | YERΔ8 |

Pathway Assembly:

Two yeast strains were prepared by integrating, into EYS1456, a single copy of the complete cycloclavine pathway (EYS1934), or a complete pathway plus an additional copy of the gene AjEasC (EYS2206). EYS1934 was prepared by integrating the constructs from pEVE2294, pEVE2312, pEVE2343, and pEVE2344 (Table 38), whereas EYS2206 was prepared by integrating the constructs from pEVE2294, pEVE2312, pEVE2343, pEVE2344, and pEVE2656 (Table 38). The resulting strains thus contained the expression cassettes for the following genes:

EYS1934: AjDmaW_altC, AfEasF, AjEasE, AjEasC, AjEasD, AjEasA, AjEasG, and AjEasH
EYS2206: AjDmaW_altC, AfEasF, AjEasE, 2×AjEasC, AjEasD, AjEasA, AjEasG, and AjEasH Growth Conditions:

The engineered yeast strains EYS1934 and EYS2206 were grown in standard SC broth with 2% glucose (ForMedium, Hunstanton, U.K.). Cultures were grown with constant shaking at 30° C. for 72 hours in 250 mL shake flasks containing 25 mL medium.

Analytical Procedures:
Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: H$_2$O+0.1% Formic Acid. Mobile Phase B: Acetonitrile+0.1% Formic Acid. Running conditions:

TABLE 39

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

EYS1934 and EY2206 were grown at 30° C. as described above. The supernatants were analyzed by LC-MS and the ion chromatograms of the expected mass of cycloclavine (m/z=239.1543+/−0.01 Da) were extracted. Also the chromatograms of a second product of the pathway, named MW241 after the m/z of approx. 241 (m/z=241.1699+/−0.01 Da), was extracted. The area under the peaks was integrated, and a comparison of the results showed an increased production in EYS2206 of both cycloclavine (CCL) and Festuclavine (MW241), as compared to EYS1934. This increase, see FIG. 21, was taken to be the effect of expressing the additional copy of the AjEasC in EYS2206, as compared to EYS1934

Example 10: Production of Cycloclavine in Baker's Yeast (*Saccharomyces cerevisiae*) by Expressing an Eight Step Heterologous Pathway, Including *N. lolii* EasE Materials and Methods:

The basic yeast strain EYS1456, used in these experiments, had the following genotype: CEN.PK 111-61A (MATα MAL2-8C SUC2 his3Δ1 leu2-3_112 ura3-52) Genes Used in Example 10 are Listed in Table 40:

TABLE 40

List of genes used in Example 10

| Gene name | Seq. ID No: | Source of sequence |
|---|---|---|
| Aj_DmaW_altC | 102 | *A. japonicus* |
| Af_EasF | 107 | *A. fumigatus* |
| Aj_EasE | 106 | *A. japonicus* |
| Nl_EasE | 161 | *N. lolii* |
| Aj_EasC | 104 | *A. japonicus* |
| Aj_EasD | 105 | *A. japonicus* |
| Aj_EasH | 109 | *A. japonicus* |

TABLE 40-continued

List of genes used in Example 10

| Gene name | Seq. ID No: | Source of sequence |
|---|---|---|
| Aj_EasA | 103 | *A. japonicus* |
| Aj_EasG | 108 | *A. japonicus* |

Cloning of Genes:

Synthetic genes, codon optimized for expression in yeast. The genes encode the amino acid sequences (Seq ID No: 102 to 109 and 161) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes (Seq ID No: 102, 107, 105, 109, 103, and 108) were cloned, using Hind III and Sac II, into yeast expression cassettes (Seq ID No: 110 and 111) containing the native yeast promoters and terminators separated by a multiple cloning site comprising Hind III and Sac II. All cassettes were flanked by Asc I restriction sites. The gene expression cassettes (Seq ID No: 110 and 111) were comprised on a pUC18 based plasmid vector (Seq ID No: 112) into which a linker (Seq ID No: 113) had been inserted to provide an Asc I site for cloning of the expression cassettes.

Gene expression cassettes were used for sub-cloning cassettes pairwise into designated Integration Vectors (Seq ID No: 114, 117, and 118), which also contained a yeast selectable marker gene. The orientation of cloning was head to head, meaning that promoters would allow transcription in opposite directions. The marker and expression cassette(s) were flanked by sequences with homology to the genomic DNA of the host. The entire integration construct (Seq ID No: 114, 117, and 118), comprising the expression cassette(s) and selection marker, flanked by the homologous sequences, were released from the pUC18 based backbone by digesting the Integration Vectors with the Sbf I restriction enzyme, and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target sites for integration are described by Flagfeldt, 2009. Seq IDs of the Integration Vectors and their integration constructs are listed in Table 41.

In addition, three plasmids were constructed: one comprised the AjEasC gene (Seq ID No: 104) cloned into pRS313. The pRS313 had already been equipped with the C/A expression cassette (Seq ID No: 121), which comprises the native yeast Cup1 promoter and Adh1 terminator. Two other plasmids, containing either the AjEasE gene from *Aspergillus japonicus* (Seq ID No: 106) or the NlEasE gene from *Neotyphodium lolii* (Seq ID No: 161), were prepared by cloning each gene into a pRS315 vector, also equipped with the C/A expression cassette (Seq ID No: 121). Cloning was done as described in Example 2.

Pathway Assembly:

A yeast strain, EYS1937, was prepared by integrating, into EYS1456, the constructs from pEVE2294, pEVE2343, and pEVE2344 (Table 41). Two strains, EYS2124 and EYS2125, were then prepared by transforming EYS1937 with the pRS vectors (see above) containing the AjEasC together with either the AjEasE or the NlEasE, respectively. The resulting strains thus contained the expression cassettes for the following genes:

EYS2124: AjDmaW_altC, AfEasF, AjEasE, AjEasC, AjEasD, AjEasA, AjEasG, AjEasH
EYS2125: AjDmaW_altC, AfEasF, NlEasE, AjEasC, AjEasD, AjEasA, AjEasG, AjEasH Growth Conditions:

The engineered yeast strains EYS2124 and EYS2125 were grown in standard SC broth with 2% glucose (ForMedium, Hunstanton, U.K.) minus leucine and histidine. Copper sulphate was added to a final concentration of 200 µM. Cultures were grown with constant shaking at 20° C. for 72 hours in 250 mL shake flasks containing 25 mL medium.

Analytical Procedures:
Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 42

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

TABLE 41

Integration Vectors and their integration constructs used in Example 10

| Construc name | SEQ ID No: | Cassette 1 | | | Cassette 2 | | | Marker | Dest. region |
|---|---|---|---|---|---|---|---|---|---|
| | | Prom. | Gene | Term. | Prom. | Gene | Term | | |
| pEVE2294 | 114 | ScPgK1 | AfEasF | ScAdh1 | ScGpd1 | AjDmaW_altC | ScCyc1 | KanMX | YorWΔ17 |
| pEVE2343 | 117 | ScPgK1 | AjEasD | ScAdh1 | ScGpd1 | AjEasH | ScCyc1 | BleR | YORWΔ22 |
| pEVE2344 | 118 | ScPgK1 | AjEasA | ScAdh1 | ScGpd1 | AjEasG | ScCyc1 | NatR | YPRC$_T$3 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The supernatants from EYS2124 and EYS2125 were analyzed by LC-MS and the ion chromatograms of the expected mass of cycloclavine (m/z=239.1543+/−0.01 Da) were extracted. Also the chromatograms of a second product of the pathway, named MW241, being Festuclavine, after the approx. m/z of 241 (m/z=241.1699+/−0.01 Da), were extracted. The area under the peaks was integrated and a comparison of the results showed production of both cycloclavine (CCL) and Festuclavine in the two strains, with production levels being higher in EYS2124 as compared to EYS2125 (see FIG. 22). This shows that, under the conditions used, the EasE gene from *A. japonicus* is more efficient than EasE from *N. lolii*, but that both of the two EasE homologues were functional and resulted in production of CCL and MW241

Example 11: Production of Cycloclavine in Baker's Yeast (*Saccharomyces cerevisiae*) by Expressing an Eight Step Heterologous Pathway, Including Synthetic EasE Genes with Different Codon Usages Materials and Methods:

The basic yeast strain EYS1456, used in these experiments, had the following genotype: CEN.PK 111-61A (MATα MAL2-8C SUC2 his3Δ1 leu2-3_112 ura3-52) Genes Used in Example 11 are Listed in Table 43:

TABLE 43

List of genes used in Example 11

| Gene name | Seq. ID No: | Source of sequence |
| --- | --- | --- |
| Aj_DmaW_altC | 102 | *A. japonicus* |
| Af_EasF | 107 | *A. fumigatus* |
| Aj_EasE | 106 | *A. japonicus* |
| Aj_EasE | 162 | *A. japonicus* |
| Aj_EasE | 163 | *A. japonicus* |
| Aj_EasE | 164 | *A. japonicus* |
| Aj_EasE | 165 | *A. japonicus* |
| Aj_EasC | 104 | *A. japonicus* |
| Aj_EasD | 105 | *A. japonicus* |

TABLE 43-continued

List of genes used in Example 11

| Gene name | Seq. ID No: | Source of sequence |
| --- | --- | --- |
| Aj_EasH | 109 | *A. japonicus* |
| Aj_EasA | 103 | *A. japonicus* |
| Aj_EasG | 108 | *A. japonicus* |

Cloning of Genes:

Synthetic genes, codon optimized for expression in yeast. The genes encode the amino acid sequences (Seq ID No: 102 to 109 and 162 to 165) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes (Seq ID No: 102, 107, 105, 109, 103, and 108) were cloned, using Hind III and Sac II, into yeast expression cassettes (Seq ID No: 110 and 111) containing native yeast promoters and terminators separated by a multiple cloning site comprising Hind III and Sac II. All cassettes were flanked by Asc I restriction sites. The gene expression cassettes (Seq ID No: 110 and 111) were comprised on a pUC18 based plasmid vector (Seq ID No: 112) into which a linker (Seq ID No: 113) had been inserted to provide an Asc I site for cloning of the expression cassettes.

Gene expression cassettes were used for sub-cloning cassettes pairwise into designated Integration Vectors (Seq ID No: 114, 117 and 118), which also contained a yeast selectable marker gene. The orientation of cloning was head to head, meaning that promoters would allow transcription in opposite directions. The marker and expression cassette(s) were flanked by sequences with homology to the genomic DNA of the host. The entire integration construct (Seq ID No: 114, 117 and 118), comprising the expression cassette(s) and selection marker, flanked by the homologous sequences, were released from the pUC18 based backbone by digesting the Integration Vectors with the Sbf I restriction enzyme, and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target sites for integration are described by Flagfeldt, 2009. Seq IDs of the Integration Vectors and their integration constructs are listed in Table 44.

TABLE 44

Integration Vectors and their integration constructs used in Example 11

| Construc name | SEQ ID | Cassette 1 | | | Cassette 2 | | | Marker | Dest. region |
| --- | --- | --- | --- | --- | --- | --- | --- | --- | --- |
| | | Prom. | Gene | Term. | Prom. | Gene | Term | | |
| pEVE2294 | 114 | ScPgK1 | AfEasF | ScAdh1 | ScGpd1 | AjDmaW_altC | ScCyc1 | KanMX | YorWΔ17 |
| pEVE2343 | 117 | ScPgK1 | AjEasD | ScAdh1 | ScGpd1 | AjEasH | ScCyc1 | BleR | YORWΔ22 |
| pEVE2344 | 118 | ScPgK1 | AjEasA | ScAdh1 | ScGpd1 | AjEasG | ScCyc1 | NatR | YPRC$_\tau$3 |

In addition, six plasmids were constructed: one comprising the AjEasC gene (Seq ID No: 104) cloned into pRS313. The pRS313 had already been equipped with the C/A expression cassette (Seq ID No: 121), which comprises the native yeast Cup1 promoter and Adh1 terminator. The other five, containing variants of the AjEasE gene from *Aspergillus japonicus* synthesized with 5 alternative codon usages (Seq ID No: 106 and 162 to 165-), were prepared by cloning into a pRS315 vector, also equipped with the C/A expression cassette (Seq ID No: 121). Cloning was done as described in Example 2.

Pathway Assembly:

A yeast strain, EYS1937, was prepared by integrating, into EYS1456, the constructs from pEVE2294, pEVE2343, and pEVE2344 (Table 44). Five strains, EYS2124, EYS2127, EYS2147, EYS2148 and EYS2149, were then prepared by transforming EYS1937 with the pRS vectors (see above) containing the AjEasC together with one version each of the AjEasE genes, respectively. The resulting strains thus contained the expression cassettes for the following genes:

EYS2124: AjDmaW_altC, AfEasF, AjEasE (Seq ID No: 106), AjEasC, AjEasD, AjEasA, AjEasG, AjEasH
EYS2127: AjDmaW_altC, AfEasF, AjEasE (Seq ID No: 162), AjEasC, AjEasD, AjEasA, AjEasG, AjEasH
EYS2147: AjDmaW_altC, AfEasF, AjEasE (Seq ID No: 163), AjEasC, AjEasD, AjEasA, AjEasG, AjEasH
EYS2148: AjDmaW_altC, AfEasF, AjEasE (Seq ID No: 164), AjEasC, AjEasD, AjEasA, AjEasG, AjEasH
EYS2149: AjDmaW_altC, AfEasF, AjEasE (Seq ID No: 165), AjEasC, AjEasD, AjEasA, AjEasG, AjEasH Growth Conditions:

The engineered yeast strains EYS2124, EYS2127, EYS2147, EYS2148 and EYS2149 were grown in standard SC broth with 2% glucose (ForMedium, Hunstanton, U.K.) minus leucine and histidine. Copper sulphate was added to a final concentration of 200 µM. Cultures were grown with constant shaking at 30° C. for 72 hours in 250 mL shake flasks containing 25 mL medium.

Analytical Procedures:

Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 45

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The supernatants from EYS2124, EYS2127, EYS2147, EYS2148 and EYS2149 were analyzed by LC-MS and the ion chromatograms of the expected mass of cycloclavine (m/z=239.1543+/−0.01 Da) were extracted. Also the chromatograms of a second product of the pathway, named MW241 due to the approx. m/z of 241 (m/z=241.1699+/−0.01 Da), was extracted. The area under the peaks was integrated and the results showed varying levels of production of both cycloclavine (CCL) and Festuclavine (MW241) in all five strains (see FIG. 23). The EasE gene versions tested all encode the same amino acid sequence, and the variation of compound production levels therefore reflects the different choice of DNA codons used in these synthetic EasE genes.

Example 12: Increased Production of Cycloclavine by Expressing an Eight Step Heterologous Pathway in Baker's Yeast (*Saccharomyces cerevisiae*), and Growing the Yeast in the Presence of Osmolytes The presence of osmolytes has been shown in some cases to improve the correct folding of proteins (Bandyopadhyay 2012, Burkewitz 2012). Here we show that the osmolyte glycerol, when added to the growth medium, can improve the production of cycloclavine based on a heterologously expressed pathway in yeast.

Materials and Methods:

The basic yeast strain EYS1456, used in these experiments, had the following genotype: CEN.PK 111-61A (MATα MAL2-8C SUC2 his3Δ1 leu2-3_112 ura3-52)

Genes Used in Example 12 are Listed in Table 46:

TABLE 46

List of genes used in Example 12

| Gene name | Seq. ID No: | Source of sequence |
|---|---|---|
| Aj_DmaW_altC | 102 | A. japonicus |
| Af_EasF | 107 | A. fumigatus |
| Aj_EasE | 106 | A. japonicus |
| Aj_EasC | 104 | A. japonicus |
| Aj_EasD | 105 | A. japonicus |
| Aj_EasH | 109 | A. japonicus |
| Aj_EasA | 103 | A. japonicus |
| Aj_EasG | 108 | A. japonicus |

Cloning of Genes:

Synthetic genes, codon optimized for expression in yeast, were manufactured by DNA2.0 Inc., Menlo Park, Calif., USA or GeneArt AG, Regensburg, Germany. The genes encode the amino acid sequences (Seq ID No: 102 to 109) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (Seq ID No: 110 and 111) containing the native yeast promoters and terminators separated by a multiple cloning site comprising Hind III and Sac II. All cassettes were flanked by Asc I restriction sites. The gene expression cassettes (Seq ID No: 110 and 111) were comprised on a pUC18 based plasmid vector (Seq ID No: 112) into which a linker (Seq ID No: 113) had been inserted to provide an Asc I site for cloning of the expression cassettes.

Gene expression cassettes were used for sub-cloning two cassettes each into designated Integration Vectors (Seq ID No: 114, 115, 117 and 118), which also contained a yeast selectable marker gene. The orientation of cloning was head to head, meaning that promoters would allow transcription in opposite directions. The marker and expression cassette(s) were flanked by sequences with homology to the genomic DNA of the host. The final integration constructs (Seq ID No: 114, 115, 117 and 118), comprising the expression cassette(s) and selection marker, flanked by the homologous sequences, were released from the pUC18 based backbone by digesting the Integration Vectors with the Sbf I restriction enzyme, and used for transformation of the yeast. Standard lithium acetate transformation protocols were used (Current Protocols; Chapter 13). Correct integration was verified by PCR, and the selection marker was loxed out (excised) after transforming the cell with a plasmid expressing the Cre recombinase as described by Sauer, 1987. The target sites for integration are described by Flagfeldt, 2009. Seq IDs of the Integration Vectors and their integration constructs are listed in Table 47.

TABLE 48

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

EYS2006 was grown at 30° C. as described above. The supernatants were analyzed by LC-MS and the ion chromatograms of the expected mass of cycloclavine (m/z=239.1543+/−0.01 Da) were extracted. Also the chromatograms of a second product of the pathway, Festuclavine

TABLE 47

Integration Vectors and their integration constructs used in Example 12

| Construc name | SEQ ID No: | Cassette 1 | | | Cassette 2 | | | Marker | Dest. region |
|---|---|---|---|---|---|---|---|---|---|
| | | Prom. | Gene | Term. | Prom. | Gene | Term | | |
| pEVE2294 | 114 | ScPgK1 | AfEasF | ScAdh1 | ScGpd1 | AjDmaW_altC | ScCyc1 | KanMX | YorWΔ17 |
| pEVE2312 | 115 | ScPgK1 | AjEasC | ScAdh1 | ScGpd1 | AjEasE | ScCyc1 | HygR | YPRCΔ15 |
| pEVE2343 | 117 | ScPgK1 | AjEasD | ScAdh1 | ScGpd1 | AjEasH | ScCyc1 | BleR | YORWΔ22 |
| pEVE2344 | 118 | ScPgK1 | AjEasA | ScAdh1 | ScGpd1 | AjEasG | ScCyc1 | NatR | YPRC$_T$3 |

Pathway Assembly:

A yeast strain (EYS2006) was prepared by integrating, into EYS1456, a single copy of the complete cycloclavine pathway, using the constructs from pEVE2294, pEVE2312, pEVE2343, and pEVE2344 (Table 47) and, in addition, introducing the 3 empty plasmids pRS313, pRS315, and pRS316 (described above). The resulting strain, thus, contained the expression cassettes for the following genes: EYS2006: AjDmaW_altC, AfEasF, AjEasE, AjEasC, AjEasD, AjEasA, AjEasG, and AjEasH Growth Conditions:

The engineered yeast strain EYS2006 was grown in standard SC broth with 2% glucose (ForMedium, Hunstanton, U.K.) minus leucine, histidine, and uracil. Cultures of EYS2006 were grown without glycerol or with 2.5%, 5%, and 10% glycerol. Cultures of 0.8 mL were grown in a BioLector fermentor (M2P-labs, Baesweiler, Germany) at 30° C. for 72 hours.

Analytical Procedures:
Sample Preparation:

Yeast cultures were spun down for 10 minutes at 1000×g. The pellet and the supernatant were separated. Without further purification 5 μL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 μm 2.1×100 mm. Liquid Chromatography method: Mobile Phase A: H$_2$O+0.1% Formic Acid. Mobile Phase B: Acetonitrile+0.1% Formic Acid. Running conditions:

(MW241) due to the approx. m/z of 241 (m/z=241.1699+/−0.01 Da), was extracted. The area under the peaks was integrated and compared (see FIG. 24). When compared to the Control (EYS2006 grown without glycerol) the cultures grown with glycerol produced more cycloclavine and Festuclavine. Under the conditions tested, the level of compound production increased with increasing concentrations of glycerol, with the highest production levels obtained with 10% glycerol.

Example 13: Increased Production of Cycloclavine by Expressing Multiple Copies of Genes from the Heterologous CCL Pathway, and Overexpressing Host Pdi1 and Fad1

Materials and Methods:

The basic yeast strain EYS1456, used in these experiments, had the following genotype: CEN.PK 111-61A (MATα MAL2-8C SUC2 his3Δ1 leu2-3_112 ura3-52) Genes Used in Example 13 are Listed in Table 49:

TABLE 49

List of genes used in Example 13

| Gene name | Seq. ID No: | Source of sequence |
|---|---|---|
| Aj_DmaW_altC | 102 | A. japonicus |
| Af_EasF | 107 | A. fumigatus |
| Aj_EasE | 106 | A. japonicus |
| Aj_EasC | 104 | A. japonicus |

TABLE 49-continued

List of genes used in Example 13

| Gene name | Seq. ID No: | Source of sequence |
|---|---|---|
| Aj_EasD | 105 | A. japonicus |
| Aj_EasH | 109 | A. japonicus |
| Aj_EasA | 103 | A. japonicus |
| Aj_EasG | 108 | A. japonicus |
| Sc_Pdi1 | 166 | S. cerevisiae |
| Sc_Fad1 | 167 | S. cerevisiae |

Cloning of Genes:

Synthetic genes, codon optimized for expression in yeast. The genes encode the amino acid sequences (Seq ID No: 102 to 109) plus a translation stop codon. The native yeast (S. cerevisiae) genes Pdi1 (Seq ID No: 166) and Fad1 (Seq ID No: 167) were amplified from genomic DNA. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (Seq ID No: 110, 111, 159 and 168) containing native yeast promoters and terminators separated by a multiple cloning site comprising Hind III and Sac II. All cassettes were flanked by Asc I restriction sites. The gene expression cassettes (Seq ID No: 110, 111 159, and 168) were comprised on a pUC18 based plasmid vector (Seq ID No: 112) into which a linker (Seq ID No: 113) had been inserted to provide an Asc I site for cloning of the expression cassettes.

Gene expression cassettes were used for sub-cloning one, two, or three cassettes into designated Integration Vectors (Seq ID No: 114, 115, 117, 118, 160, 169, 170, and 171), which also contained a yeast selectable marker gene. The marker and expression cassette(s) were flanked by sequences with homology to the genomic DNA of the host. The final integration constructs (Seq ID No: 114, 115, 117, 118, 160, 169, 170, and 171), comprising the expression cassette(s) and selection marker, flanked by the homologous sequences, were released from the pUC18 based backbone by digesting the Integration Vectors with the Sbf I restriction enzyme, and used for transformation of the yeast. Standard lithium acetate transformation protocols were used (Current Protocols; Chapter 13). Correct integration was verified by PCR. The target sites for integration are described by Flagfeldt, 2009. Seq IDs of the Integration Vectors and their integration constructs are listed in Tables 50a and 50b.

TABLE 50a

Integration Vectors and their integration constructs Part 1

| Construc name | SEQ ID No: | Cassette 1 | | | Cassette 2 | | |
|---|---|---|---|---|---|---|---|
| | | Prom. | Gene | Term. | Prom. | Gene | Term |
| pEVE2294 | 114 | ScPgK1 | AfEasF | ScAdh1 | ScGpd1 | AjDmaW_altC | ScCyc1 |
| pEVE2312 | 115 | ScPgK1 | AjEasC | ScAdh1 | ScGpd1 | AjEasE | ScCyc1 |
| pEVE2343 | 117 | ScPgK1 | AjEasD | ScAdh1 | ScGpd1 | AjEasH | ScCyc1 |
| pEVE2344 | 118 | ScPgK1 | AjEasA | ScAdh1 | ScGpd1 | AjEasG | ScCyc1 |
| pEVE2656 | 160 | ScGpd1 | AjEasC | ScCyc1 | | | |
| pEVE2658 | 169 | Pyk1 | ScPdi1 | Tef1 | Gpd1 | ScFadi | ScCyc1 |
| pEVE2682 | 170 | ScGpd1 | AjEasH | ScCyc1 | Pyk1 | AjDmaW_altC | ScAdh1 |
| pEVE2723 | 171 | ScGpd1 | AjEasH | ScCyc1 | Pyk1 | AjEasC | ScAdh1 |

TABLE 50b

Integration Vectors and their integration constructs Part 2

| Construc name | SEQ ID No: | Cassette 3 | | | Marker | Dest. region |
|---|---|---|---|---|---|---|
| | | Prom. | Gene | Term | | |
| pEVE2294 | 114 | | | | KanMX | YorWΔ17 |
| pEVE2312 | 115 | | | | HygR | YPRCΔ15 |
| pEVE2343 | 117 | | | | BleR | YORWΔ22 |
| pEVE2344 | 118 | | | | NatR | YPRC$_\tau$3 |
| pEVE2656 | 160 | | | | KanMX | YERΔ8 |
| pEVE2658 | 169 | | | | BleR | YHRCLΔ14 |
| pEVE2682 | 170 | | | | HygR | YMRWLΔ15 |
| pEVE2723 | 171 | Tef2 | AjEasE | Pgi1 | NatR | YNRCΔ9 |

Pathway Assembly:

Three yeast strains were prepared by integrating, into EYS1456, a single copy of the complete cycloclavine pathway (EYS1934), or a complete pathway plus additional copies of CCL pathway genes and host genes. Hence, EYS1934 was prepared by integrating the constructs from pEVE2294, pEVE2312, pEVE2343, and pEVE2344 (Table 50), EYS2209 was prepared by integrating the constructs from pEVE2294, pEVE2312, pEVE2343, pEVE2344, pEVE2656, and pEVE2658 (Tables 50a and 50b), and EYS2297 was prepared by integrating the constructs from pEVE2294, pEVE2312, pEVE2343, pEVE2344, pEVE2656, pEVE2658, pEVE2682, and pEVE2723 (Tables 50a and 50b). The EYS1934 had had the selection markers loxed out (excised) by expressing the Cre recombinase (described in Sauer, 1987) and served as an intermediate for preparation of EYS2209 and EYS2297. The resulting strains thus contained the expression cassettes for the following genes:

EYS1934: AjDmaW_altC, AfEasF, AjEasE, AjEasC, AjEasD, AjEasA, AjEasG, and AjEasH EYS2209: AjDmaW_altC, AfEasF, AjEasE, 2×AjEasC, AjEasD, AjEasA, AjEasG, AjEasH, ScPdi1, and ScFad1

EYS2325: 2×AjDmaW_altC, AfEasF, 2×AjEasE, 3×AjEasC, AjEasD, AjEasA, AjEasG, 3×AjEasH, ScPdi1, and ScFad1

Growth Conditions:

The engineered yeast strains EYS1934 and EYS2209 were grown in a BioLector (M2P labs, Baesweiler, Germany) in standard SC+all broth with 2% glucose (ForMedium, Hunstanton, U.K.). To extend the growth phase 10% glycerol was added to the growth medium. Cultures were grown with constant shaking at 30° C. for 72 hours. Subsequently, the EYS2209 and EYS2297 were grown at identical conditions.

Analytical Procedures:
Sample Preparation:

Yeast cultures were spun down for 10 minutes at 1000×g. The pellet and the supernatant were separated. Without further purification 5 μL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 51

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The culture supernatants of EYS1934 and EYS2209 were analyzed by LC-MS and the ion chromatograms of the expected mass of cycloclavine (m/z=239.1543+/−0.01 Da) were extracted. The area under the peaks was integrated, and a comparison of the results showed an increased production of cycloclavine in EYS2209 as compared to EYS1934 (FIG. 25, left) and reached a titer of almost 12 mg/L under these conditions. This increase was taken to be the effect of expressing additional copies of Aj_EasC, Sc_Pdi1, and Sc_Fad1 in EYS2209, as compared to EYS1934.

Using identical growth conditions, as well as extraction and analytical methods, the EYS2209 and EYS2297 were compared and this showed a further increase in CCL titer, to 22 mg/L, in EYS2297 as compared to EYS2209 (FIG. 25, right). This increase was taken to be the effect of expressing additional copies of Aj_DmaW_altC, Aj_EasC, Aj_EasE, and Aj_EasH (×2) in EYS2297, as compared to EYS2209.

Example 14: Increased Production of Cycloclavine by Continuous Feeding of Glucose Materials and Methods:

The yeast strain EYS2325, used in these experiments, had the following genotype: MATα MAL2-8C SUC2 his3Δ1 leu2-3_112 ura3-52 YERCΔ8::AjEasC/KanMX YHRCΔ14::ScPdi1/ScFad1/BleR YMRWΔ15::AjEasH/AjDmaW/HygR YNRCΔ9::AjEasH/AjEasC/AjEasE/Nat YORWΔ17::AjDmaW/AfEasF YORWΔ22::AjEasH/AjEasD YPRCt3::AjEasG/AjEasA YPRCΔ15::AjEasE/AjEasC [ARS/CEN/URA3] [ARS/CEN/HIS3] [ARS/CEN/LEU2]

It was prepared by transforming the strain EYS2297 (described in Example 13) with the 3 empty plasmids pRS313, pRS315, and pRS316 (Sikorski, 1989) in order to make the strain prototroph.

Production of CCL with strain EYS2325 is coupled to biomass production (in-house observation), and hence we set up a fed-batch fermentation process that aimed to produce high biomass. A conventional feeding regime was chosen and aeration and stirring regimes were aimed to avoid fermentative metabolism and minimize glucose accumulation and ethanol and/or acetate formation.

The process was started as a batch using synthetic complete medium (SC), after which a feed was started that contains glucose, salts, vitamins, trace metals and amino acids. The platform used for the described fermentation process is a Multifors 2 from Infors AG, Bottmingen, Switzerland using vessels with a maximal working volume of 1 L. The starting volume was 0.32 L, and during the feeding phase a total of 435.6 mL of feed was added using a predefined exponential feeding regime, resulting in a final volume of approximately 755 mL of fermentation broth.

Seed Cultures

A two-stage seed train was chosen before inoculation of the fermenter. The first seed culture was prepared by inoculating 100 mL of medium in a 500 mL shake flask with 4 baffles (indents), starting from a freshly grown plate. The medium consisted of SC-His-Leu-Ura-medium with 20 g/L glucose (ForMedium, Hunstanton, U.K.). The shake flask was placed on a shaking table at 160 rpm at 30° C. The cells were grown into exponential phase until the OD600 was approx. 0.5, which was before glucose depletion. Using the first seed culture a second 100 mL SC-His-Leu-Ura-medium seed culture was then prepared in a 500 mL shake flask with 4 baffles (indents), with enough inoculum to reach an initial OD600 of 0.025. The cells were grown into exponential phase until OD600 reached 3.2, which was before glucose depletion.

Fermentation Batch Phase.

The fermentation was performed in a Multifors 2 fermenter (Infors AG, Bottmingen, Switzerland) with a maximum working volume of 1 L. The fermenter was equipped with two Rushton six-blades and 4 baffles. Air was used for sparging the fermenter. Temperature, pH, agitation, and aeration rate was controlled throughout the cultivation. The temperature was maintained at 20° C. The pH was kept at 5.85 by automatic addition of 5M NH4OH or 0.5M HCl. The stirrer speed was set to 800 rpm and the aeration rate kept at 1 vvm [L gas/(L liquid×min)]. The fermentation was started as a batch of 38 hours, with a starting volume of 0.32 L SC-His-Leu-Ura, 20 g/L glucose and 0.01% antifoam solution (AF204, Sigma). Prior to inoculation, 10 mL of medium in the fermenter was removed. Next, an aliquot of 10 mL of the second-stage seed culture (see above) was used for inoculation of the fermenter to a final volume of 0.32 L. Hence the inoculation ratio was 3% (v/v), giving a start OD600 of 0.1.

Feed Composition and General Conditions

After a batch fermentation time of 38 hrs, the feed was started with a mixture of glucose, vitamins, trace-metals and salts, and further enriched with amino acids (See tables 52, 53, and 54).

TABLE 52

Composition of feed mixture used in fed-batch cultivations, with NH4OH as nitrogen source

| Ingredient | Concentration (g/l) |
|---|---|
| Total carbon source | 600 |
| Glucose * $H_2O$ | 660 |

TABLE 52-continued

Composition of feed mixture used in fed-batch cultivations, with NH$_4$OH as nitrogen source

| Ingredient | Concentration (g/l) |
|---|---|
| YNB w/o amino acids and ammonium | 10.2 |
| SC drop-out mix (-His-Leu-Met-Trp-Ura) | 3.9735 |
| L-Methionine | 0.2568 |
| L-Tryptophan | 0.2568 |
| KH$_2$PO$_4$ | 10.8 |
| MgSO$_4$ * 7H$_2$O | 6.12 |
| K$_2$SO$_4$ | 4.2 |
| Na$_2$SO$_4$ | 0.336 |
| Trace metal stock solution (see Table 53) | 15 (ml) |
| Vitamin stock solution (see Table 54) | 15 (ml) |

TABLE 53

Trace metal stock solution

| Compound | Concentration (g/l) |
|---|---|
| Na$_2$EDTA + 2H$_2$O | 15 |
| ZnSo$_4$*7H$_2$O | 4.5 |
| FeSO$_4$*7H$_2$O | 3 |
| CaCl$_2$*2H$_2$O | 3 |
| MnCl$_2$*4H$_2$O | 1 |
| CoCl$_2$*6H$_2$O | 0.32 |
| CuSO$_4$*5H$_2$O | 0.3 |
| Na$_2$MoO$_4$*H$_2$O | 0.4 |
| H$_3$BO$_3$ | 1 |
| KI | 0.1 |

TABLE 54

Vitamin stock solution

| Compound | Concentration (g/l) |
|---|---|
| D-biotin | 0.1 |
| Ca-Pantothenate | 2 |
| Thiamine-HCl | 2 |
| Pyridoxine-HCl | 2 |
| Nicotinic acid | 2 |
| p-aminobnzoic acid | 2 |
| m-inositol | 0.05 |

During said feeding phase, ammonium hydroxide (5M NH4OH) was used both as the nitrogen source and as base to control pH. The acid used to control pH was 0.5M HCl. Air was used for sparging the bioreactor. Temperature, pH, agitation, and aeration rate was controlled throughout the cultivations. The temperature was maintained at 20° C. The pH kept at 5.85, by automatic addition of 5M NH4OH or 0.5M HCl. The stirrer speed was initially set to 800 rpm and aeration rate was initially set to 1.0 vvm. Stirrer speed was manually increased in steps, according to a time schedule (see below) reaching a maximum of 1200 rpm. Aeration was manually increased in steps to maintain a sufficient aeration rate during the volume and biomass increase (see below). The management of aeration and stirring aimed to prevent the Dissolved Oxygen (DO) to drop below 10-20%. The general operating conditions during the fed-batch phase were: liquid volume: 0.32-0.755 L, temperature 20° C., pH 5.85, agitation speed 800-1200 rpm, and air flow rate 1-2 vvm.

The expected total addition of feed was 435.6 mL in 72 hrs, according to the feed regime outlined below. The hold-up of gas was not excessive, but was still expected to augment the actual volume by as much as 10%. The formation of foam and gas-holdup was controlled by addition of antifoam into the "SC-His-Leu-Ura" medium used in the initial batch phase of the fed-batch cultivation. Samples were withdrawn twice a day and analysed for CCL production. The increase in biomass was mainly followed by the increase in OD600.

Feeding Regime

For the feeding phase a pre-defined exponential feeding regime was used, which was not controlled by any type of set-point, such as dissolved oxygen, or anything else. The exponential feeding profile is shown in Table 55, and the stirring and aeration rates are given in Table 56.

TABLE 55

Feed profile during the feeding phase of the fed-batch cultivation

| Time t (h) | F(t) mL/h | F(t) mL/min | Time t (h) | F(t) mL/h | F(t) mL/min | Time t (h) | F(t) mL/h | F(t) mL/min |
|---|---|---|---|---|---|---|---|---|
| 38 | 0.6 | 0.01 | 62 | 2.1 | 0.035 | 86 | 6.9 | 0.115 |
| 39 | 0.7 | 0.011 | 63 | 2.2 | 0.037 | 87 | 7.3 | 0.121 |
| 40 | 0.7 | 0.012 | 64 | 2.3 | 0.038 | 88 | 7.6 | 0.127 |
| 41 | 0.7 | 0.012 | 65 | 2.4 | 0.04 | 89 | 8 | 0.134 |
| 42 | 0.8 | 0.013 | 66 | 2.5 | 0.042 | 90 | 8.4 | 0.141 |
| 43 | 0.8 | 0.013 | 67 | 2.7 | 0.045 | 91 | 8.9 | 0.148 |
| 44 | 0.8 | 0.014 | 68 | 2.8 | 0.047 | 92 | 9.3 | 0.156 |
| 45 | 0.9 | 0.015 | 69 | 3 | 0.049 | 93 | 9.8 | 0.164 |
| 46 | 0.9 | 0.016 | 70 | 3.1 | 0.052 | 94 | 10.3 | 0.172 |
| 47 | 1 | 0.016 | 71 | 3.3 | 0.054 | 95 | 10.8 | 0.181 |
| 48 | 1 | 0.017 | 72 | 3.4 | 0.057 | 96 | 11.4 | 0.19 |
| 49 | 1.1 | 0.018 | 73 | 3.6 | 0.06 | 97 | 12 | 0.2 |
| 50 | 1.1 | 0.019 | 74 | 3.8 | 0.063 | 98 | 12.6 | 0.21 |
| 51 | 1.2 | 0.02 | 75 | 4 | 0.067 | 99 | 13.2 | 0.221 |
| 52 | 1.3 | 0.021 | 76 | 4.2 | 0.07 | 100 | 13.9 | 0.232 |
| 53 | 1.3 | 0.022 | 77 | 4.4 | 0.074 | 101 | 14.6 | 0.244 |
| 54 | 1.4 | 0.023 | 78 | 4.6 | 0.077 | 102 | 15.4 | 0.257 |
| 55 | 1.5 | 0.024 | 79 | 4.9 | 0.081 | 103 | 16.2 | 0.27 |
| 56 | 1.5 | 0.026 | 80 | 5.1 | 0.085 | 104 | 17 | 0.284 |
| 57 | 1.6 | 0.027 | 81 | 5.4 | 0.09 | 105 | 17.9 | 0.298 |
| 58 | 1.7 | 0.028 | 82 | 5.7 | 0.094 | 106 | 18.8 | 0.313 |
| 59 | 1.8 | 0.03 | 83 | 6 | 0.099 | 107 | 19.8 | 0.329 |
| 60 | 1.9 | 0.031 | 84 | 6.3 | 0.104 | 108 | 20.8 | 0.346 |
| 61 | 2 | 0.033 | 85 | 6.6 | 0.11 | 109 | 21.8 | 0.364 |

TABLE 56

Operating conditions for the feeding phase of the fed-batch cultivation

| Incubation (h) | Feeding | Changes to stirrer speed and aeration |
|---|---|---|
| 37.99 | Start | |
| 68.56 | | Increase of stirrer from 800 to 1000 rpm |
| 68.57 | | Increase of flow from 0.32 to 0.5 NL/min |
| 69.06 | | Increase of stirrer from 1000 to 1100 rpm |
| 92.89 | | Increase of flow from 0.5 to 1 NL/min |
| 92.9 | | Increase of stirrer from 1100 to 1200 rpm |
| 97.89 | | Increase of flow from 1 to 1.5 NL/min |
| 109.99 | End | |
| 116.31 | | End of fermentation |

Analytical Procedures:

Sample Preparation:

Yeast samples, taken during fermentation, were spun down for 10 minutes at 1000×g. The pellet and the supernatant were separated. Without further purification 5 μL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: H$_2$O+0.1% Formic Acid. Mobile Phase B: Acetonitrile+0.1% Formic Acid. Running conditions:

TABLE 57

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results

Production of CCL and Festuclavine (FCL) were measured, and compound titer/hour was plotted against cell density (OD600)(see FIG. 26). It showed an increase in both compounds correlated to the increase in cell mass. The increase in biomass was estimated by converting OD600 into cell-dry-weight (CDW) by multiplying with a factor of 0.49 in an Ultrospec 10 Cell Density Meter, Amersham Biosciences.

The concentration of CCL that was obtained with this process, measured in the clarified broth (i.e. after removing of cells), was ca. 789 mg/L (See FIG. 26). Though a fraction of CCL was detected intracellularly as well, we were still able to isolate the majority of the CCL from the clarified broth. In addition, approx. 114 mg/L of FCL was produced.

In summary, the results show that increasing the cell mass of EYS2325 during a controlled fed-batch fermentation process, increases the production of CCL and FCL.

Example 15: Production of Cycloclavine in Yeast Strains with Different Genetic Background Materials and Methods:

The yeast strains used in this experiment are listed in Table 58:

TABLE 58

Seven strains with different genetic background, transformed with the two plasmids HRT1 and HRT5, were analysed in this experiment

| Strain | Description | Parent Strain |
|---|---|---|
| EYS2387 | MATα his3Δ1 leu2Δ0 lys2Δ0 ura3Δ0 HRT1 HRT5 | BY 4742 |
| EYS2393 | MATα leu2-3_112 ura3-52 pep4-3 ssc1-1 ssc2-1 HRT1 HRT5 | CGY 1585 |
| EYS2395 | MATα Δhis3 Δleu2 Δura3 (×2) HRT1 HRT5 | Ethanol Red |
| EYS2396 | MATα MAL1-8C SUC2 his3Δ1 leu2-3_112 ura 3-52 HRT1 HRT5 | CEN.PK 111-61A |
| EYS2397 | MATα his3Δ200 leu2Δ1 trpΔ63 ura3-52 GAL2 HRT1 HRT5 | FY1679-06C |
| EYS2398 | MATa ade2-1 his3-11 leu2-3_112 trp1Δ-2 ura3-52 can1-100 HRT1 HRT5 | BMA64 (W303) |
| EYS2399 | MATα suc2Δ9 his3Δ200leu2-3_112 lys2-801 trpΔ901 ura3-52 GAL HRT1 HRT5 | SEY 6210 |

Genes Used in Example 15 are Listed in Table 59:

TABLE 59

List of genes used in Example 15

| Gene name | Seq. ID No: | Source of sequence |
|---|---|---|
| Cp_DmaW | 123 | C. purpurea |
| Af_EasF | 102 | A. fumigatus |
| Aj_EasE | 106 | A. japonicus |
| Aj_EasC | 104 | A. japonicus |
| Aj_EasD | 105 | A. japonicus |
| Aj_EasH | 109 | A. japonicus |
| Aj_EasA | 103 | A. japonicus |
| Aj_EasG | 108 | A. japonicus |

Cloning of Genes:

Synthetic genes, codon optimized for expression in yeast. The genes encode the amino acid sequences (Seq ID No:123 and 102 to 109) plus a translation stop codon. During synthesis all genes were provided, at the 5'-end, with the DNA sequence AAGCTTAAA comprising a Hind III restriction recognition site, and at the 3'-end the DNA sequence CCGCGG comprising a Sac II recognition site. Genes were cloned, using Hind III and Sac II, into yeast expression cassettes (Seq ID No: 110, 111, 124, and 172) containing native yeast promoters and terminators separated by a multiple cloning site comprising Hind III and Sac II. All cassettes were flanked by Asc I restriction sites. The gene expression cassettes (Seq ID No: 110, 111, 124, and 172) were comprised on a pUC18 based plasmid vector (Seq ID No: 112) into which a linker (Seq ID No: 113) had been inserted to provide an Asc I site for cloning of the expression cassettes.

Gene expression cassettes were sub-cloned into pUC18 based recombination vectors, each of which had a 120 bp homologous recombination tag (HRT) sequence, flanked by Asc I sites and an Mlu I site in the center. These HRTs were designed such that the second half of the first tag is identical to the first half of the second tag, and so forth.

Three helper fragments were used to assemble two plasmids, which together comprised the entire CCL pathway: One helper fragment comprised a yeast auxotrophic marker and the bacterial pMB1 origin of replication. The second helper fragment comprised the ARS4/CEN6 sequence for replication in yeast and the bacterial chloramphenicol resistance marker. Both fragments had flanking HRTs. The third fragment was designed only with HRTs separated by a short 600 bp spacer sequence. All helper fragments had been cloned in a pUC18 based backbone for amplification in E. coli. All fragment were cloned in Asc I sites from where they could be excised.

To prepare the two plasmids, CCL-HRT1 and CCL-HRT5 (Seq ID No: 173 and 174), plasmid DNA from the three helper plasmids was mixed with plasmid DNA comprising either CpDmaW, AfEasF, AjEasE, and AjEasC for CCL-HRT1, or AjEasD, AjEasG, AjEasH, and AjEasA for CCL-HRT5. The mixes of plasmid DNA were digested with Asc I. This releases all fragments from the plasmid backbone, and creates fragments with HRTs at the ends, these being sequentially overlapping the HRT of the next fragment. Yeast strain EYS1456 was transformed with each of the digested mixes, and the plasmids CCL-HRT1 and CCL-HRT5 were assembled in vivo by homologous recombination as described by Shao 2009. The two plasmids were isolated from yeast transformants, and transformed back into E. coli which allowed easy amplification and purification of plasmid DNA. The two plasmids CCL-HRT1 and CCL-HRT5 were co-transformed into a panel of yeast strains (Table 58).

Growth Conditions:

The engineered yeast strains, comprising the two vectors CCL-HRT1 and CCL-HRT5, were grown in 3 mL standard SC broth, minus leucine and uracil, with 2% glucose (For-Medium, Hunstanton, U.K.). Cultures were grown with constant shaking at 20° C. for 96 hours.

Analytical Procedures:

Sample Preparation:

Yeast cultures were spun down for 10 minutes at 1000×g. The pellet and the supernatant were separated. Without further purification 5 µL of supernatant were injected in a UPLC-TOF (Waters Acquity™ Ultra Performance LC, Waters, Milford, Mass., USA), coupled to a micrOTOF-Q II (Bruker Daltonik GmbH, Bremen, Germany). Stationary Phase: Column was an Acquity UPLC® Bridged Ethyl Hybrid (BEH) C18 1.7 um 2.1×100 mm. Liquid Chromatography method: Mobile Phase A: $H_2O$+0.1% Formic Acid. Mobile Phase B: Acetonitrile+0.1% Formic Acid. Running conditions:

TABLE 60

| Time (min) | Flow (mL/min) | % mobile phase A | % mobile phase B |
|---|---|---|---|
| T = 0 | 0.400 | 99.0 | 1.0 |
| 12.00 | 0.400 | 50.0 | 50.0 |
| 15.00 | 0.400 | 0.0 | 100.0 |
| 17.00 | 0.400 | 0.0 | 100.0 |
| 17.10 | 0.400 | 99.0 | 1.0 |
| 19.00 | 0.400 | 99.0 | 1.0 |

PDA parameters: λ range: 210 nm to 500 nm. Resolution: 1.2 nm. Sampling rate: 5 points/sec. ELSD parameters: Gain: 50, Gas Pressure: 40 psi, Nebulizer Mode: heating, Power Level: 80%, Drift tube: 80° C. TOF parameters: Source: End Plate Offset: −500 V. Capillary: −4500 V. Nebulizer: 1.6 bar. Dry Gas: 8.0 L/min. Dry Temperature: 180° C. Scan mode: MS Scan. Mass range: from 80 to 1000 m/z.

Results:

The culture supernatants of all strains were analyzed by LC-MS and the ion chromatograms of the expected mass of cycloclavine (m/z=239.1543+/−0.01 Da) and the expected mass of festuclavine (m/z=241.1699+/−0.01 Da) were extracted. The areas under the peaks were integrated and production of CCL and FCL were calculated based on internal standards. The amounts of CCL and FCL were compared (FIG. 27) showing production of both compounds in all strains, but in varying amounts. These results show that CCL and FCL production does not depend on a specific strain or genotype of S. cerevisiae.

REFERENCES

Bandyopadhyay A, Saxena K, Kasturia N, Dalal V, Bhatt N, Rajkumar A, Maity S, Sengupta S, Chakraborty K. Chemical chaperones assist intracellular folding to buffer mutational variations. Nat Chem Biol. 2012 Jan. 15; 8(3):238-45.

Burkewitz K, Choe K P, Lee E C, Deonarine A, Strange K. Characterization of the proteostasis roles of glycerol accumulation, protein degradation and protein synthesis during osmotic stress in C. elegans. PLoS One. 2012; 7(3):e34153. Epub. 2012 Mar. 28.

Cheng J Z, Coyle C M, Panaccione D G, O'Connor S E. Controlling a structural branch point in ergot alkaloid biosynthesis. J Am Chem Soc. 2010 Sep. 22; 132(37): 12835-7.

Current Protocols in Molecular Biology, Eds Ausubel F. M. et al. Wiley & Sons, U.K.

Flagfeldt D B, Siewers V, Huang L, Nielsen J. Characterization of chromosomal integration sites for heterologous gene expression in Saccharomyces cerevisiae. Yeast. 2009 October; 26(10):545-51.

Fleetwood D J, Scott B, Lane G A, Tanaka A, Johnson R D. A complex ergovaline gene cluster in epichloe endophytes of grasses. Appl Environ Microbiol. 2007 April; 73(8): 2571-9.

Goetz K E, Coyle C M, Cheng J Z, O'Connor S E, Panaccione D G. Ergot cluster-encoded catalase is required for synthesis of chanoclavine-I in Aspergillus fumigatus. Curr Genet. 2011 June; 57(3):201-11.

Lorenz N, Olsovská J, Sulc M, Tudzynski P. Alkaloid cluster gene ccsA of the ergot fungus Claviceps purpurea encodes chanoclavine I synthase, a flavin adenine dinucleotide-containing oxidoreductase mediating the transformation of N-methyl-dimethylallyltryptophan to chanoclavine I. Appl Environ Microbiol. 2010 March; 76(6):1822-30.

Matuschek M, Wallwey C, Xie X, Li S M. New insights into ergot alkaloid biosynthesis in Claviceps purpurea: an agroclavine synthase EasG catalyses, via a non-enzymatic adduct with reduced glutathione, the conversion of chanoclavine-I aldehyde to agroclavine. Org Biomol Chem. 2011 Jun. 7; 9(11):4328-35.

Peroutka R J, Elshourbagy N, Piech T, Butt T R. Enhanced protein expression in mammalian cells using engineered SUMO fusions: secreted phospholipase A2. Protein Sci. 2008 September; 17(9):1586-95.

Rigbers O, Li S M. Ergot alkaloid biosynthesis in Aspergillus fumigatus. Overproduction and biochemical characterization of a 4-dimethylallyl-tryptophan N-methyltransferase. J Biol Chem. 2008 Oct. 3; 283(40):26859-68.

Sauer B. Functional expression of the cre-lox site-specific recombination system in the yeast Saccharomyces cerevisiae. Mol Cell Biol. 1987 June; 7(6):2087-96.

Shao Z, Zhao H, Zhao H. DNA assembler, an in vivo genetic method for rapid construction of biochemical pathways. Nucleic Acids Res. 2009 February; 37(2):e16

Sikorski R S, Hieter P. A system of shuttle vectors and yeast host strains designed for efficient manipulation of DNA in Saccharomyces cerevisiae. Genetics. 1989 May; 122(1): 19-27.

Unsöld I A, Li S M. Overproduction, purification and characterization of FgaPT2, a dimethylallyltryptophan synthase from Aspergillus fumigatus. Microbiology. 2005 May; 151(Pt 5):1499-505.

Wallwey C, Matuschek M, Li S M. Ergot alkaloid biosynthesis in Aspergillus fumigatus: conversion of chanoclavine-I to chanoclavine-I aldehyde catalyzed by a short-chain alcohol dehydrogenase FgaDH. Arch Microbiol. 2010 February; 192(2):127-34.

Wallwey C, Li S M. Ergot alkaloids: structure diversity, biosynthetic gene clusters and functional proof of biosynthetic genes. Nat Prod Rep. 2011 March; 28(3):496-510.

SEQUENCE LISTING (192 sequences)

SEQ ID NO: 1 - protein, 534 aa, Aspergillus japonicus
MTAGQGIKTGNASDCEVYRTLSVALDFANQDEELWWHSTAPMFAQMLQSTNYNLHAQYKHLLIYKKNVIPFLGVYPTNDKPRWLSILTRYGTPFELSLNCSGPLVRYTYEPINAATGTARDPFNTHAVWDSLEQLMALQSGIDLDLFRHFKNDLTLSAEESEYLYKNNLVGEQIRTQNKLALDLQDGEFVVKTYIYPALKSLATGRSIHELVFGSAFRWSKQYPELRKPLDTLEQYVYSRGPSSTASPRLLSCDLIDPTKSRIKIYLLERMVTLEALEDLWTMGGERTDASTLAGLEMIRELWELIRLPAGLQSYPAPYLPIGTIPDEQLPLMANYTIHHDDPVPEPQVYFTTFGRNDMQIADALATFFERRGWHEMARQYKAELCSHYPHADHETLNYLHAYISFSYRKNKPYLSVYLQSLETGDWVTCKLSPSVFLSCTLPHRGYIPDDLTCSRSILQLCPCGPRPLSHRPRAVQADQDRRDHRSRDETPTHPGWIGARRHHPVLGNHLVGPDLPASRRGVASALYVGRGTR

SEQ ID NO: 2 - protein, 412 aa, Aspergillus japonicus
MTIDPSSPGAPASKLFQPMKIGLCHLQHRLIMAPTTRYRADSTATPLPFVQEYYAQRAAVPGTLLITEATDISPQAAGEPHIPGLYSATQIAAWRGIVSAVHRRGCYIFCQLWATGRAADPALLKEKGFPLVSSSDVPIETESQQPQPLTQAEIEGYIADFVTAARVAVHEVGFDGVELHGANGYLIDQFTQWPCNQRTDCWGGSIENRARFALAVTRAVVDAVGAERVGVKLSPWSQYAGMGVMADLVPQFEFLIKRLREEYNDGPGLAYLHLANSRWLDEETSHPDPHHEVFVRAWRGSGRDGIEAKKEAPPVILAGGYDAVSAPEVADKVFKEEDNVAVAFGRYFISTPDLPFRMQRGIPLQKYDRASFYTSLLKEGYLDYPYSAEYVAEFGQRLKKKEAAATGSICQG

SEQ ID NO: 3 - protein, 509 aa, Aspergillus japonicus
MAPDSKPTYTTANGCPFHKPEGPPADGRTLALSDHHLVDTLAHFNREKIPERVVHAKGAGAYGEFEVTADISDICDIDMLVGVGKKTPCVTRFSTTGLERGSNEGMRDLKGMACKFYTTEGNWDWVMLNFPFFFIRDPVKFPSLMHAQRRDPQTNLLNPNMYWDWVTNNHESLHMVLLQFSDFGTMFNWRSMSGYMAHAYKWVKPDGSFKYVHIFLSSDRGPNFTDGQQAKGTNDLDPDHATRDLYEAIERGEYPTWTASVQVVDPKDAPNLGYNILDVTKHWNLGTYPKDVTLIPPKVFGKLTLKRNPANYFAEIEQLAYSPSNMVPGVAPSEDPILQARIFAYPDAQRYRLGANHQQIPVNRSAHTFNPIARDGQGTFDANYGAHPGFLTQQQPVRFAEPREPDPKYNEWLKEIQSKSWLQTTEHDYKFARDFYEVLPDFRGQEFQDTMVQNMVESVAQTRAEIQKQVYETWKLVSPALAARIQKGVETLLQKSEAPAEESFIPARL

SEQ ID NO: 4 - protein, 262 aa, Aspergillus japonicus
MTVVNSRIFAVTGGASGIGAATCRLLAARGAAVICIGDISPKGFESVTSDIQALNPATKVHCTRLDVSSSAEVDAWLQTIVQTFGDLHGLANVAGIAQPAGARQAPALLEETDEEWQRVFKVNLDGVFYCTRAGIRAMKALPGPKDRAIVNIGSIAAFIHLPDAYAYGTSKGACAYFTSCAAMDAWPLGIRINSVSPGITDTPALPQFMPQAKSIDEVKEAYIKEGFPIIQPEDVARTIVWLLSEDSRPVYGANINVGAATP

SEQ ID NO: 5 - protein, 621 aa, Aspergillus japonicus
MGQSRGILGGVRQLILVILVGAYLSRLSAVDDDRHDCRCRPGEPCWPTVSHWSTLNESIGGALAHVKPIAHVCHQSGQDSSACEQVLQESLDSKWRASHTGALQDWVWEGGAESNQTCYYLRSGPAGSCHQGRIPLYSAAVKSASDVQKVVDFTRQHNLRLVIRNTGHDGSGRSSGPDSVEIHTHHLNSVQYHPNFRPAGSSERQSAPGQPAVTVGAGILLGDLYARGASEGWIVVGGECPTVGAAGGFLQGGGVSSWLSYAHGLAVDNVLEYEVVTAKGEIVIANAHQNPDLFWALRGGGGGTFGVVTQATLQVHPDLPVSVADAVVTGSRADATFWSHGVAALLRALQFLNNHGTAGQFILRNTDDDTVQASLTMYFSNLTVPAVADERMDPLRRALEHNGHPYQLTSRFLPQISSTFRHTADRYPEDYGILMGSVLVSLDLFNSATGPAALAQHFARLPMTPDDLLFTSNLGGRVSSLNRDPASTAMHPGWRDAAQLLNFVRGVGAPSLAAKATALHELQTVQMARLYEIEPAFQISYRNLGDPSERRSREVYWGSNYARLVEVKRRWDPEGLFFSKLGIDGDAWDAEGMCRQTRQGAWNVAVKWVQSFLGSLSASVV

SEQ ID NO: 6 - protein, 339 aa, Aspergillus japonicus
MGSINPPILDIRQSTFETSIPQQVTEGLTKDPKTLPALLFYSGDGIQHWTRHSCAPDFYPRREEINILHSEAAHMAASISQDSVVVDLGSASLDKVLPFLHALEAQQKRVHYYALDLSYPVLASTLSEIPVAQFQYVQIAALHGTFEDGLQWLHDSPEVRERPHHLLLFGLTIGNFSRPNAAAFLRNIADRALAASPAESSILLTLDSCKMPTKVLRAYTAEGVVPFALTSLSYANQLFWPGGEGRVFDEEEWYFHSEWNFALGRHEAALIPRDRDITLGPPLEQVVVRRGEKVRFGCSYKYSAAEREHLFAGAGLENVASWSAKGCDVAFYQLKMRPE

SEQ ID NO: 7 - protein, 284 aa, Aspergillus japonicus
MTILVLGGRGKTASRLSALLHEAQIPFVVGTSSTAPIATYRTAHFDWLNKDTWTNAWDQAPEPITAIYLVGAHAPEFVHPMFEFIDLAHSRGVRRYALVSASNTEKGDPMMGEAHAHLDSKEGVKYVVLRPTWFMENHIEDPHLSWIKTENKIYSATGPGKIPFVSADDIARVAFHALTQPLTQKEQQYMVLGPDLLSYADMAEILTDLLGRKITHVTLPAEKFGQFLVDTAGLPPDFAEMLATMEAAVATGAEERVSQDVEKVTGRPPRRFVDYARENREHWL

SEQ ID NO: 8 - protein, 293 aa, Aspergillus japonicus
MTITETSKPTLRRIPRSAGDEAIFQVLQEDGVVVIEGFMSADQVRRFNGEIDPHMKQWELGQKSYQESYLAGMRQLSSLPLFSKLFRDELMNDELLHGLCKRLFGPESGDYWLTTSSVLETEPGYHGQELHREHDGIPICTTLGRQSPESMLNFLTALTDFTAENGATRVLPGSHLWEDFSAPPPKADTAIPAVMNPGDAVLFTGKTLHGAGKNNTTDFLRRGFPLIMQSCQFTPVEASVALPRELVETMTPLAQKMVGWRTVSAKGVDIWTYDLKDLATGIDLKSNQVAKKA

SEQ ID NO: 9 - protein, 440 aa, Saccharomyces cerevisiae
LQLALHPVEMKAALKLKFCRTPLFSIYDQSTSPYLLHCFELLNLTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLAGIHEQSTFQFCAIPQVMAIATLALVFNNREVLHGNVKIRKGTTCYLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIILSVLLGFYYIYTLHRA

SEQ ID NO: 10 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 11 - protein, 1054 aa, Saccharomyces cerevisiae
MPPLFKGLKQMAKPIAYVSRFSAKRPIHIILFSLIISAFAYLSVIQYYFNGWQLDSNSVFETAPNKDSNTLFQECSHYYRDSSLDGWVSITAHEASELPAPHHYYLLNLNFNSPNETDSIPELANTVFEKDNTKYILQEDLSVSKEISSTDGTKWRLRSDRKSLFDVKTLAYSLYDVFSENVTQADPFDVLIMVTAYLMMFYTIFGLFNDMRKTGSNFWLSASTVVNSASSLFLALYVTQCILGKEVSALTLFEGLPFIVVVVGFKHKIKIAQYALEKFERVGLSKRITTDEIVFESVSEEGGRLIQDHLLCIFAFIGCSMYAHQLKTLTNFCILSAFILIFELILTPTFYSAILALRLEMNVIHRSTIIKQTLEEDGVVPSTARIISKAEKKSVSSFLNLSVVVIIMKLSVILLFVFINFYNFGANWVNDAFNSLYFDKERVSLPDFITSNASENFKEQAIVSVTPLLYYKPIKSYQRIEDMVLLLLRNVSVAIRDRFVSKLVLSALVCSAVINVYLLNAARIHTSYTADQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 12 - protein, 288 aa, Saccharomyces cerevisiae
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRML

SEQ ID NO: 13 - protein, 396 aa, Saccharomyces cerevisiae
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 14 - protein, 451 aa, Saccharomyces cerevisiae
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDK

SEQ ID NO: 15 - protein, 443 aa, Saccharomyces cerevisiae
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTS

SEQ ID NO: 16 - protein, 491 aa, Saccharomyces cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 17 - protein, 398 aa, Saccharomyces cerevisiae
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 18 - protein, 1045 aa, Saccharomyces cerevisiae
MSLPLKTIVHLVKPFACTARFSARYPIHVIVVAVLLSAAAYLSVTQSYLNEWKLDSNQYSTYLSIKPDELFEKCTHYYRSPVSDTWKLLSSKEAADIYTPFHYYLSTISFQSKDNSTTLPSLDDVIYSVDHTRYLLSEEPKIPTELVSENGTKWRLRNNSNFILDLHNIYRNMVKQFSNKTSEFDQFDLFIILAAYLTLFYTLCCLFNDMRKIGSKFWLSFSALSNSACALYLSLYTTHSLLKKPASLLSLVIGLPFIVVIIGFKHKVRLAAFSLQKFHRISIDKKITVSNIIYEAMFQEGAYLIRDYLFYISSFIGCAIYARHLPGLVNFCILSTFMLVFDLLLSATFYSAILSMKLEINIIHRSTVIRQTLEEDGVVPTTADIIYKDETASEPHFLRSNVAIILGKASVIGLLLLINLYVFTDKLNATILNTVYFDSTIYSLPNFINYKDIGNLSNQVIISVLPKQYYTPLKKYHQIEDSVLLIIDSVSNAIRDQFISKLLFFAFAVSISINVYLLNAAKIHTGYMNFQPQSNKIDDLVVQQKSATIEFSETRSMPASSGLETPVTAKDIIISEEIQNNECVYALSSQDEPIRPLSNLVELMEKEQLKNMNNTEVSNLVVNGKLPLYSLEKKLEDTTRAVLVRRKALSTLAESPILVSEKLPFRNYDYDRVFGACCENVIGYMPIPVGVIGPLIIDGTSYHIPMATTEGCLVASAMRGCKAINAGGGATTVLTKDGMTRGPVVRFPTLIRSGACKIWLDSEEGQNSIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVKSVLKSDVSALVELNISKNLVGSAMAGSVGGFNAHAANLVTALFLALGQDPAQNVESSNCITLMKEVDGDLRISVSMPSIEVGTIGGGTVLEPQGAMLDLLGVRGPHPTEPGANARQLARIIACAVLAGELSLCSALAAGHLVQSHMTHNRKTNKANELPQPSNKGPPCKTSALL

SEQ ID NO: 19 - protein, 479 aa, Aspergillus japonicus
MTAGQGIKTGNASDCEVYRTLSVALDFANQDEELWWHSTAPMFAQMLQSTNYNLHAQYKHLLIYKKNVIPFLGVYPTNDKPRWLSILTRYGTPFELSLNCSGPLVRYTYEPINAATGTARDPFNTHAVWDSLEQLMALQSGIDLDLFRHFKNDLTLSAEESEYLYKNNLVGEQIRTQNKLALDLQDGEFVVKTYIYPALKSLATGRSIHELVFGSAFRWSKQYPELRKPLDTLEQYVYSRGPSSTASPRLLSCDLIDPTKSRIKIYLLERMVTLEALEDLWTMGGERTDASTLAGLEMIRELWELIRLPAGLQSYPAPYLPIGTIPDEQLPLMANYTIHHDDPVPEPQVYFTTFGRNDMQIADALATFFERRGWHEMARQYKAELCSHYPHADHETLNYLHAYISFSYRKNKPYLSVYLQSLETGDWVTSSFNSVHVDPGLSATVQELSKLTKTAGTTVRETKLPLTPDGSEPGVITQY

SEQ ID NO: 20 - protein, 441 aa, Paecilomyces divaricatus
MSSRKTRNASSSEVYQTLSSLFDFPDEEQKLWWHSTAPMFADMLQTANYDTHAQYRHLGIYKKYVIPFLGVYPTNDRDRWLSILTRYGTPFELSLNCSDDVVRYTFEPINAATGTIQDPFNTHAIWDCLQNFSPMLKGVDLEWFSYFKEKLTLNADESAFLVENNLADDPIKTQNKLALDLKNSGFVLKTYIYPALKSIATGLAAPLSVIDEYVHSRGPNGTAGPRLFSCDLVHPSKSRIKIYILERMVSLAAMEDLWTLGGRRKDHSTLAGLNMIRELWELIQLPAGLRSYPEPYLPLGTIPNEQLPLMANYTLHQDDPWPEPQVYFTPFGMNDMAIADALTTFMERRGWNDMAQSYKDNLCSYYPNADHDHLNYVHAYISFSYRNDKPYLSVYLHSFETGDWKISNFTNPESKCKEPQRVSVRFPVQGRGRGRIPASGY

SEQ ID NO: 21 - protein, 457 aa, Trichophyton equinum
MGSIEIPNCSGSIVYKTISDFIDFPSHEQKLWWHSTAPMFAEMLRVAGYDLHSQYKILGIFLNHVIPFLGVYPTRINNRWLSILTRYGTPFELSLNCSQSLVRYTYEPINSATGTVKDPFNTHSIWDALDRLMPLQKGIDLEFFKHLKQDLTVDDQDSAYLLENNLVGGQIRTQNKLALDLKGGNFVLKTYIYPALKALATGKSIKTLMFDSVYRLCRQNPSLEAPLRALEEYVDSKGPNSTSSPRLLSCDLIDPSKSRVKIYILELNVTLEAMEDLWTMGGRLNDASTLAGLEMLRELWDLIKLPPGMREYPEPFLQLGTIPDEQLPLMANYTLHHDQAMPEPQVYFTTFGLNDGRIADGLVTFFERRGWNHMAQTYKDSLRAYYPHADQETLNYLHAYISFSYRKGKPYLSVYLQTFETGDWPICKCAAVERRKWNINLTDIVSQLWDPGGQASP

SEQ ID NO: 22 - protein, 459 aa, Aspergillus fumigatus
MKAANASSAEAYRVLSRAFRFDNEDQKLWWHSTAPMFAKMLETANYTTPCQYQYLITYKECVIPSLGCYPTNSAPRWLSILTRYGTPFELSLNCSNSIVRYTFEPINQHTGTDKDPFNTHAIWESLQHLLPLEKSIDLEWFRHFKHDLTLNSEESAFLAHNDRLVGGTIRTQNKLALDLKDGRFALKTYIYPALKAVVTGKTIHELVFGSVRRLAVREPRILPPLNMLEEYIRSRGSKSTASPRLVSCDLTSPAKSRIKIYLLEQMVSLEAMEDLWTLGGRRRDASTLEGLSLVRELWDLIQLSPGLKSYPAPYLPLGVIPDERLPLMANFTLHQNDPVPEPQVYFTTFGMNDMAVADALTTFFERRGWSEMARTYETTLKSYYPHADHDKLNYLHAYISFSYRDRTPYLSVYLQSFETGDWAVANLSESKVKCQDAACQPTSLPPDLSKTGVYYSGLH

SEQ ID NO: 23 - protein, 456 aa, Epichloe brachyelytri
MAMAKTLHQEVYQTLSEIFDFANNDQRLWWHSTAPMFEKMLQTANYSIHAQYRHLGIYKRHIIPFLGVYPTRSGQRWLSILTRYGTPFELSLNCSDSIVRYTYEPINAATGSHLDPFNTFAIWEALKNLMDFQLGIDLEWFSYFKQELTLDANESTYLHSQNLVKEQIKTQNKLALDLKGDKFVLKTYIYPELKSVATGKSVQELVFGSVRKLAQKHKSIRPAFEMLEDYVQSRNEVSTTDGSHSTPLSSRLLSCDLMSPTKSRVKIYLLERMVSLPAIEDLWTLGGRREDQSTIEGLEMIRELWGLLNMSPGLRAYPKPYLPLGAIPNEQLPSMANYTLHHNDPMPEPQVYFTVFGMNDMEVTDALTTFFMRHDWSDMASKYKASLRESFPHHNYEALNYIHSYISFSYRKNKPYLSVYLHSFETGDWPVFPDSLTAFDAYRRDSTCYKKIWLWQ

SEQ ID NO: 24 - protein, 455 aa, Metarhizium robertsii
MKIEERMGHSVYETLSLIFDFPNDDQKLWWHSTAPMFEAMLQTAGHTIDTQYRHLGIYKKHVIPFLGVYPTNDKERWLSILTRYGIPFELSLNCSNSVVRYTYEPINAASGTQKDPYNTLAIWESLQKLVQIQAGIDVEWFKYFKRELTLNTAESAYLFDNGLAKDEIKTQNKLALDLKGNQFAVKVYIYPALKSLATGKSMHELIFGSVHKLSLQYSSIRAAFERLEGFVISRNSRAQTGDCGALHPRLLSCDLVDPAKSRIKIYLLEQMVSLSAMEDLWTLGGQLTDQSTMDGLDLIRELWDLLRIPPGLRSYPEPYLALGKVPDERLPSMVNYTLHHDDPTPEPQVYFTVFGMSDLDVTNALTVFFERRGWSEMATKYRAFLQKSFPHDDHESLNYIHTYISFSYRNNKPYLSVYLHSFESGNWPVLPDVPVAFDAFRREPSPYKKIELGLD

SEQ ID NO: 25 - protein, 456 aa, Periglandula ipomoeae
MATVNESGRGVYDTLSLIFDFPDDEQRLWWHSTAPMFAAMLQTAGHNVHDQYRHLGIYKKNIIPFLGVYPTEGKGRWLSILTRYGIPFELSLNCSNSIVRYTYEPINEATGTDKDPYNTLAILESLQKLVQIQSGIDLEWFNYFKHELTLNGTESAYLRSNDLVNCQIKTQNKLALDLKGNQFALKVYIYPELKSTATGKSIHELIFGSVRKLSLEHPSIQPAFQVLDDYVASRNISAETGGEYSALQPRLLSCDLINPAKSRVKIYLLERTVSLSAMEDLWTLGGRRTDPSTMDGLDMVRELWNLLEMPAGLQAYPKPYLQLGKIPNEQLPSMANYTLHHNDPMPEPQVYFTVFGMSDFKVTNALTVFFERRGWNEMARKYRVFLQESYPNDDLESLNYLHTYISFSYRSNKPYLSVYLHTFESGHWPIFPDSPTAFDAYRRCDMASKKINLADY

SEQ ID NO: 26 - protein, 450 aa, Neotyphodium coenophialum
MVLAKTLHQEVYQTLSETFDFANNDQRLWWHSTAPMFQKILQTANYSIYAQYQHLSIYKSHIIPFLGVYPTRSGERWLSILTRYGTPFELSLNCSDSIVRYTYEPINAATGSHLDPFNTFAIWEALKKLIDSQPGIDLQWFSYFKQELTLDANESTYLHSQNLVKEQIKTQNKLALDLKGDKFVLKTYIYPELKSVATGKSVQELVFGSVRKLAQKHKSIRPAFEMLEDYVQSRNKVPTTDDSHNTPLSSRLLSCDLVSPTKSRVKIYLLERMVSLPAMEDLWTLGGRREDQSTIEGLEMIRELWGLLNMSPGLRAYPEPYLPLGAIPNEQLPSMANYTLHHNDPIPEPQVYFTVFGMNDMEVTNALTKFFMRHEWSDMASKYKACLRESFPHHNYEALNYIHSYISFSYRNNKPYLSVYLHSFETGEWPVFPEGLIAFDGCRRDLTCYK

SEQ ID NO: 27 - protein, 465 aa, Balansia obtecta
MATENGPDKSVYETLSLIFNFPDDTQRLWWHSTAPMLAEMLQTCEYSVHNQYQQLGIFKKHIIPYLGVYPTKSKERWLSILTRYGIPFELSLNCSDSVVRYTYEPINEATGTEKDPYNTLAILDSAQELIRIQAGIDLEWFTYFKDELTVNMTESEYLRSNGLVNCQIKTQNKLALDLKGDQFTLKVYMYPELKSVATGKSLHELIFGSVRRLSLKYNSIRAPLDMLDDYVTSRNMGANGEEHLPLEPRLLSCDLMDPHKSRVKIYLHERKVSLSAMEDLWTLGGRRTDSTTMDGLNMVRELWDLLEIPTCLQKYPAPFLELGQIPREQLPSMANYTLHHGDPMPEPQVYFTVFGMNDSKVISALTEFFKRRVWNGMARKYRAFLQNSYPNDDHESLNYLHTYISFSYRKNKPYLSVYLHTFESGSWPIFPDSSTAFKTYRRCDLSCKDNGLDDKLLSPVCQLRV

SEQ ID NO: 28 - protein, 448 aa, Claviceps purpurea
MSTAKDPGNGVYEILSLIFDFPSNEQRLWWHSTAPMFAAMLDNAGYNIHDQYRHLGIFKKHIIPFLGVYPTKDKERWLSILTRCGLPLELSLNCTDSVVRYTYEPINEVTGTEKDPFNTLAIMASVQKLAQIQAGIDLEWFSYFKDELTLDESESATLQSNELVKEQIKTQNKLALDLKESQFALKVYFYPHLKSIATGKSTHDLIFDSVFKLSQKHDSIQPAFQVLCDYVSRRNHSAESDQHIALHARLLSCDLIDPAKSRVKIYLLEKTVSLSVMEDLWTLGGQRVDASTMDGLDMLRELWSLLKVPTGHLEYPKGYLELGEIPNEQLPSMANYTLHHNNPMPEPQVYFTVFGMNDAEISNALTIFFQRHGFDDMAKKYRVFLQDSYPYHDFESLNYLHAYISFSYRRNKPYLSVYLHTFETGRWPVVADSPISFDAYRRCDLSTK

SEQ ID NO: 29 - protein, 306 aa, Penicillium roqueforti
SMAPMFAEMLKVAGYDIHSRYKALGLYQKFIIPFLGVYPTKTNDRWLSILTRYGTPFELSLNCTHSVVRYTFEPINAATGSLKDPFNTHAIWDALDTLIPLQKGIDLEFFAHLKRDLTVNDQDTAYLLEKKKVGGQIRTQNKLALDLKGGEFVLKAYIYPALKSLATGKPVQELMFDSVHRLSHQYPTLAAPLRKLEEYVHSRGTSSTASPRLISCDLCDPRQSRIKIYLLELNVSLESMEDLWTLGGRRNDTQTLAGLEMIRELWDLINLPTGILSYPEPYLKLGEVPNEQLPLMANYTLHHDDP

SEQ ID NO: 30 - protein, 329 aa, Arthroderma gypseum
MPLQKGIDLEFFKHLKQDLTVDDQDSAYLLENNLVGGQIRTQNKLALDLKGGNFVLKTYIYPALKALATGKSIKTLMFDSVYRLCRQNPSLEAPLRVLEEYVDSKGPNSTASPRLLSCDLIDPSKSRVKIYILELNVTLEAMEDLWTLGGRLNDAATLAGLEMVRELWDLVKLPPGLRDYPEPFLQLGTIPDEQLPLMANYTLHHNEAMPEPQVYFTTFGLNDGRIAEGLVTFFERRGWDHMARTYKDSLRAYYPHADQETLNYLHAYISFSYRKGTPYLSVYLQTFETGDWPISNFGIPVVKPLRSNVGCQHPISFSIPITKAPLLGV

SEQ ID NO: 31 - protein, 379 aa, Paecilomyces divaricatus
MTQASPASKLFTPLSVGSCKLYHRLVMAPMTRFRADESAIQLPFVKEYYGQRASVPGTLLISEATDISPQAGGFANVPGIWNEAQIQAWRQIVGEVHSKGSFIFCQLWATGRAAEPSVLAEKGFTLVSSSATPISPDGLLPCALTEVEIHDYIDDFAQAAQNAILAGFDGVEIHGANGYLIDQFTQASCNKRIDHWGGSIANRARFAIEVTRAVVAAVGADRVGVKLSPWSQYQGMGNMDGLVAQFEYLISQLQKMDLAYLHLANSTWLGEEGPHSDPHHEVFVQAWGKSKPILLAGGYDAASAKQVVDMLYGEHDNVAIAFGRFFISNPDLPFRVKSNVKLQDYSRSSMDTSVSKDGYLDHPFSPEFLASNRSEFAST

SEQ ID NO: 32 - protein, 376 aa, Aspergillus fumigatus
MREEPSSAQLFKPLKVGRCHLQHRMIMAPTTRFRADGQGVPLPFVQEYYGQRASVPGTLLITEATDITPKAMGYKHVPGIWSEPQREAWREIVSRVHSKKCFIFCQLWATGRAADPDVLADMKDLISSSAVPVEEKGPLPRALTEDEIQQCIADFAQAARNAINAGFDGVEIHGANGYLIDQFTQKSCNHRQDRWGGSIENRARFAVELTRAVIEAVGADRVGVKLSPYSQYLGMGTMDELVPQFEYLIAQMRRLDVAYLHLANSRWLDEEKPHPDPNHEVFVRVWGQSSPILLAGGYDAASAEKVTEQMAAATYTNVAIAFGRYFISTPDLPFRVMAGIQLQKYDRASFYSTLSREGYLDYPFSAEYMALHNFPV

SEQ ID NO: 33 - protein, 380 aa, Neotyphodium lolii
MSTSNLFTPLQFGKCLLQHKLVLSPMTRFRADNEGVPLPYVKTYYCQRASLPGTLLLTEATAISRRARGFPNVPGIWSQEQIAGWKEVVDAVHAKGSYIWLQLWATGRAAEVGVLKANGFDLVSSSAVPVSPGEPTPRALSDDEINSYIGDFVQAAKNAVLEAGFDGVELHGANGFLIDQFLQSPCNQRTDQWGGCIENRSRFGLEITRRVIDAVGKDHVGMKLSTWSTFQGMGTMDDLIPQFEHFIMRLREIGIAYLHLANSRWVEEEDPTIRTHPDIHNETFVRMWGKEKPVLLAGGYGPESAKLVVDETYSDHKNIGVVFGRHYISNPDLPFRLKMGLPLQKYNRETFYIPFSDEGYLDYPYSEEYITENKKQAVLA

SEQ ID NO: 34 - protein, 380 aa, Periglandula ipomoeae
MSTSNLFNELPFGTSVLKHKIVLSPMTRFRADNGGVPLPYVKTYYAQRASVHGTLLITEAVAICPRAKGFPNIPGIWHDSQIAAWKGVVDEVHSKGSVIWLQLWATGRAVDPDTLTSNGLELKSSSEVPVAPGEPTPRPLSEEEIQSYIFDYAQGAKNAVHEAGFDGVEIHGANGFLIDQFLQSSCNRRTDQWGGSIENRSRFGLEITRRVIDAVGNDHVGVKLSPWSTFQGMGTMDDLVPQFEHFITRLREMDIAYLHLANSRWVEEEDPSIKTHPDVHNETFVRIWGEKRPILLAGGYNPDSARRLVDQTYSEQNNVMVVFGRHYISNPDLPFRLKMGIALQRYNRDTFYIPFSGEGYLDYPFCKEYLKQGDQETTVA

SEQ ID NO: 35 - protein, 382 aa, Claviceps fusiformis
MSSSNLFKPIPLGRKVLQHKVVLSPMTRFRADNDGVPLSYVKSYYGQRASIRGTLLITEAVAICPRAKGFSNCPGIWHQDQIAAWKEVVDEVHSKGSVIWLQLWATGRASDADTLKESGFHLESSSDVPVAPGEPVPRPLSEDEIESYIRDYVTGAINAVQGAGFDGIEIHGANGFLVDQFLQASCNTRADQWGGSIENRSRFGLEITRRVVDAVGKDRVGVKLSPWSTFQGMGTMDDLVAQFEHFISRLREMDIAYIHLVNTRWLEEEEPGIKTHPDVDNQTFVRMWGNKTPILLAGGYDADSARRLVDETYSDQNNIMVVFGRHYISNPDLPFRLRLGIPLQKYNRDTFYIPFSDEGYLDYPFCQEFLDQQDVDQVVVAA

SEQ ID NO: 36 - protein, 368 aa, Penicillium chrysogenum
MTKLFTPLRVGRAELSNRIAMAPMTRFRADDNHTPLPIVKDYYAQRASVPGTLLITEATFISARAGGYPNVPGIYNDAQIAAWKEVTDAVHAKGSYIYLQLWALGRVASVELLQASGFDLVSSSATPASADAPVPRALTESEIHEWIADYAQAARNAVAAGFDGVEIHAANGYLIDQFTQDTCNTRDDAWGGSVEGRARFAVEVSRAVVEAVGADRTGIRFSPWSTFQGMRMEEPKPQFEYLAERMAEMGLAYVHLVESRIAGNAEVEADDDLDFFLKAYGKASPVIVAGGYVADSALQAADVKYAEYDAIVGIGRPFISNPDLPFRVQKGIPFVPYDRDTFYVPKDPKGYIDYAFSAEFQKSIEAAA

SEQ ID NO: 37 - protein, 369 aa, Claviceps purpurea
MSTSNLFSTVPFGKNVLNHKIVLSPMTRFRADDNGVPLSYMKTFYAQRASVRGTLLVTDAVAICPRTKGFPNVPGIWHKDQIAAWKEVVDEVHSKGSFIWLQLWATGRAADLEALTSQGLKLESSSEVPVAPGEPTPRALDEDEIQQYILDYVQGAKNAVHGAGFDGVEIHGANGFLIDQFLQSSCNRRTDQWGGSIENRSRFGLEITRGVVDAVGHDRVGMKLSPWSTFQGMGTMDDLVPQFEHFITCLREMDIAYLHLANSRWVEEEDPSIRTHPDFHNQTFVQMWGKKRPILLAGGYDPDSARRLVDQTYSDRNNVLVVFGRHYISNPDLPFRLRMGIACRSTIETHSIFPARERAMWTIPSVKNI

SEQ ID NO: 38 - protein, 370 aa, Aspergillus flavus
MASKLFSPLQVGRMQLAHRITMAPLTHFRNDDDHVPLPIVKEHYEQRGSVPGTLLITEATLISPRAGGYPNVPGIWSEAQIAAWRTVTDAVHAKGSYIFMQLWALGRVANPANLQKAGYDLVSSSAVPATPEGAVPRALTEDEIRDYIRDYAQAAKNAIAAGFDGVEIHGANGYLIDQFTQDTVNQRTDSWGGSVENRARFALEVTKAVTEAIGAERTGIRFSPFSTFQGMRMADPVPQFEYLAQKTKEFKLAYVHLVEPRIAGNTEVDEPSADSLDFFFRAYEKAGPIMVAGGYKAESAKEAVDSQYKDYDTLVAMGRPFTSNPDLPFKVKAGIPLRAYEREKFYLVKDPKGYTDYEFSEEFKSAQVAA

SEQ ID NO: 39 - protein, 380 aa, Neurospora tetrasperma
MAAAAESRLFQPLKLTPRITLAHRLAMAPLTRFRSDDEHVPIVPLMTTYYSQRASVPGTLLVTEATFISPAAGGYDNVPGIYNAAQIAAWKKITDAVHAKGSFIFCQLWSLGRAANPEVLAKEGGFKLKSSSAVPMEEGAPVPEEMTVAEIKERVAEYAGAAKNAIEAGFDGVEIHGANGYLIDQFLQDTCNQRTDEYGGSVENRSRFALEVVKAVVEAVGAERTGIRLSPYSTFQGMKMKKDLVPQFEDVIRKISGFGLAYLHLTQSRVAGNMDVQPGEDEESLAFAARLWDGPLLIAGGLTAETAKHLVDHEFPEKDVVATFGRHFISTPDLPFRIKEGIELNPYDRDTFYLPKSPVGYIDQPFSKEFEKVYGAQALN

SEQ ID NO: 40 - protein, 367 aa, Aspergillus terreus
MSSSKLFEPLRVGQVELQHRVVMAPLTRFRNTEDNLPLPIVTKYYEQRASVPGTLLIAEANQISPAAAGMPHGPAIWNEAHVQAWKKVTDAVHAKGSHIYCQLIALGRAAHGPTLQKYGDYEVSAPSPIPMEKDGVPPKELTEAQIQGFIADFAQAGKNAIAAGFDGVEVHGANGYLVDQFTQDVTNQRTDGWGGSVANRARFAIEVARALVDAVGADRVAFRLSPWNTWQGMKMADPVPQFSYLVEKLKELKLAYLHLVESRVINNIDCEKGEGLEFLLDIWGKTSPVLVAGGYTPENCREVDEQYKNNDVAVVFGRHFISNPDLPFRIKNSIALQKYDRDTFYTPIQEEGYLDYPFSPEFTAAQA

SEQ ID NO: 41 - protein, 519 aa, Paecilomyces divaricatus
MRTKDDNAPKPDPDGVPAYTTSNGCPVMRPEGLPADGRKLLLNDSHLIDMLAHFNREKIPERAVHAKGAGAYGEFEVTEDISDICNIDMLLGVGKKTPCVTRFSTTGLERGSSDGVRDLKGLATKFYTKQGNWDWVCLNFPFFFIRDPMKFPSLMHAQRRDPQTNLLNPNMYWDWVTSNHESLHMVLLQFSDFGTMFNWRSMSGYIGHAYKWVMPDGSYKYVHIFLSSNQGPNFTDGGPDKKDNGLEPDHATRDLYEAIESGDYPSWTANVQVVDPKDAPKLGFNILDITKHWNLGTYPKDLEAIPSRPFGKLTLNRNPQNYFAEIEQLAFSPSNMVPGVEPSEDPILQARMFAYPDAQRYRLGVNNQHLPVNRPQHVFNPLLRDGAGMASGNYGSLPGYVSDYHPMKFQKPTPQNPEFDSWLAQISSQSWGQSNEQDYKFAREYYLALPEFRSQEFQDTMVRNICQSVAQTNREIREKTYRTFDLVHRGLADRIRQGVEELVAEAFVIPRGSSSSLRL

SEQ ID NO: 42 - protein, 520 aa, Aspergillus fumigatus
MLIERGLLSIMASKCSGTWSTYKTYTTANGCPFMKPEGPPADGRTLALNDHHLVESLAHFNREKIPERAVHAKGAAAYGEFEVTADISDICNIDMLLGVGKKTPCVTRFSTTGLERGSAEGMRDLKGMATKFYTKEGNWDWVCLNFPFFFIRDPLKFPSLMHAQRRDPRTNLLNPNMYWDWVTSNHESLHMVLLQFSDFGTMFNWRSLSGYMGHAYKWVMPNGSFKYVHIFLSSDRGPNFSQGEQAKDNSDLDPDHATRDLYEAIERGDYPTWTANVQVVDPAEAPDLGFNILDVTKHWNLGTYPKDLPKIPSRPFGKLTLNRIPDNFFAEVEQLAFSPSNMVPGVLPSEDPILQARMFAYPDAQRYRLGPNHHKIPVNQCPMTFNPTLRDGTGTFDANYGSLPGYVSESQGVNFARPQEHDPKFNAWLSQLSSRPWMQTNENDYKFPRDFYNALPEFRSQEFQDKMVENIIASVAQTRREIREKVYHTFHLVDPELSARVKRGVEKMDASFKQVSLSRL

SEQ ID NO: 43 - protein, 483 aa, Trichophyton rubrum
MAPNAADKCPVMNTTGEKCPVMNPNGLSSSTQSRGPRDIYTLEALSHFNREKIPERAVHAKGTGAYGEFEVTADISDICNIDMLLGVGKKTQCVTRFSTTGLERGSSDGVRDLKGMAVKFFTEQGDWDWVSLNFPFFFIRDPAKFPDMIHSQRRDPQTNLLNPNMTWDFVTKNPEALHMTLLQHSDFGTMFTWRTLSSYVGHAFKWVMPDGSFKYVHFFLASDRGPNFTDGSTAKIDPNDPDFATKDLFEAIERGDYPSWTANVQVVDPKDAPKLGFNILDITKHWNLGTYPKGLDTIPSRPFGKLTLNRNVKDYFSEVEKLAFSPSNLVPGVEPSEDPILQARMFAYPDAQRYRLGIDHLKAPLRRKETACQQDLGPEFEKWLSQVTSEAWSHPYEDDYKFAREYYEVLPEFRSQEFQDRMVENLCRSIAPGPEELRKRVFDTFELVSSELARRLREGVEAIVAEKARPDSPSRAQPGQLRL

SEQ ID NO: 44 - protein, 482 aa, Arthroderma otae
MAPNAADKCPVMNNAAEKCPVMHSNGVSSIQSHGPRDIYTLEALSHFNREKIPERAVHAKGTGAYGEFEVTADISDICNVDMLLGVGKKTQCVTRFSTTGLERGSSDGVRDLKGMAVKFFTEQGDWDWVSLNFPFFFIRDPAKFPDMIHSQRRDPQTNLLNPSMTWDFVTKNPEALHMTLLQHSDFGTMFTWRTLSSYAGHAFKWVMPDGSFKYVHFFLASDRGPNFTDGSTAKIDPNDPDFATKDLFEAIERGDYPTWTANVQVIDPKDAPKLGFNILDITKHWNLGTYPKGLDTIPSRPFGKLTLNRNVKDYFTEVEKLAFSPSNLVPGVEPSEDPILQARMFAYPDAQRYRLGIDHLKAPIRRKETSCKHDLGPEFDQWLSQVTSESWSHPHEDDYKFAREYYEVLPEFRSQEFQDRMVENLYKSVAQGPEDLRKRVYETFELVSTELARRVREGAEVIVADMAQPDSPERAQPGQQRL

SEQ ID NO: 45 - protein, 476 aa, Periglandula ipomoeae
MASKTSVETNESGDSRSQRGRGYQAYSAIDHRLLDSLSRFNREKIPERAVHARGAGAYGEFEVTDDISDICDIDMLLGIGKKTPCVVRFSTTTLERGSAEAVRDVKGMAIKLFTQDGNWDWVCLNIPMFFIRDPSKFPDLIHAQRPDPKTNLTNPSKWWEFVCNNHETLHMVMFQFSDFGTMFDYRSMSGYVSHAYKWVMPDGSWKYVHWFLASDQGPNFEKGKQTKEIAPNDPESATRDLHQSLDRGEYPTWTVNVQVVDPEDAHQLAFNILDVTKHWNLGNYPPDIPVIPSRRFGKLTLKQGPKDYFEEIEQLAFSPSHLVHGVEPSEDPMLQARLFAYPDAQRHRLGPQNLDMPANRTRHTADGAKTKKVVPPEKKSREHAEWVSQMTSSSWSQPDEADYKFPREFWKALPRLRGEEFQNNLVVNMSKSVSQIPVDLRQKVYNTLGLVAEDLADRVKAMTEEMIMESEQRARL

SEQ ID NO: 46 - protein, 476 aa, Epichloe festucae
MSDIVSVSVNGLQNVSLKENDELKNPSRMDFRLINTLSQFNREKIPERAVHARGAGAYGEFEVTHDISDICDIDMLLGIGKKTHCAVRFSTTALERGSPEYIRDAKGMAVKFFTQEGNWDWVCLNIPMFFIRDPIKFPALIHAQRPDPRTNMTNPRNWWEFVCDNHEALHMVMFQFSDFGTMFNYRSMSAYVGHAYKWAMPDGSWKYVHWFLSSDQGPNFENGSQANDIAPNDLESATRDLYESIERGGYPTWTANVQVVDPEDAHKLAFNILDLTKHWNLGNYPPDIPVIPSRPFGKLTLKKNPKDYFQEIEQLAFSPSHLVPGVEPSEDPMLQARLFAYPDAQRYRLGPHNLQLSPNQTRHTTESTRSRISARTKSADPKHTAWLSATVSEAWSQPNELDYKYPREFWKALPRLRSEEFQSNVVVNMAKSVSQVPHELRERVYHTLNLIATDLADRVKQTTEKMVVEKETTARL

SEQ ID NO: 47 - protein, 516 aa, Hypocrea atroviridis
MVHSDNVPKGGTSDNDPREKPKMFTTSNGCPAKSPESSPMASNMLLLRDFQLIDLLSHLNRERIPERVVHAKGAGAFGEFEVTHDISDICSIEMLNGIGKKTQCLVRFSTTGGERGSADSVRDARGFAVKCYTKEGNWDWVWNDVPFFFIRDPIKFPGMIHAQKRDPRSNLRDPTRFWSWVIQNPESLHMVMWLYSDYGTFSSYRHMNGYMGHAHKWVMPDGSFKYVHMYLEADLGYKNHSDEDIPHMTGNDPDHAARDLYDAIERGEYPTYTAKVQVIDPADVRKFGYNILDMTKHWDMGTYPTDLGTVGARVVGKLTLNRNPENHFAQIEQAAFSPSHLVPGIEPSEDPMLQARFFAYADAQRYRLGVNYQQIPVNQPKHAFNPLLRDGAASVLGNYGSHPGFVTRKDTMQFRHFESSSTPEHKKWLAEIASEPNERKEELDLRFAHTFWTHLDDPQYEGWQERMVRSLGRDIAGVEMETRDQVFQVLKKVHSELAARVEEKVEERLAQAKSRL

SEQ ID NO: 48 - protein, 476 aa, Metarhizium robertsii
MAHNSSTETKGSHDAGLKDNRGPQSNPGLNYNLLDKLAQFNREKIPERAVHARGAGAYGEFEVTDDISDICDIDMLLGVGKKTPCVVRFSTTALERGSAEAVRDVKGLAVKFFTQQGNWDWVCLNIPMFFIRDPIKFPDLVHAQRPDPKTNLTNPSNWWEFVCNNHETLHMVMFQFSDFGTMFDYRSMSGYVGHAYKWVKPDGSWKYVHWFLSSDQGPNFEQGSQTKELAPDDQESATRDLNESLERGECPSWTANVQVIDPEDAHKLPFNILDVTKHWNLGNYPPDIPVIPSRRFGKLTLKKGPKDYFQEIEQLAFSPSHLVPGVEPSEDPMLQARLFAYPDAQRHRLGPHNLEMPANQPRQTVEDTKAKDSVRPEPKSQEHSAWVSETTSSEWSQPNELDYKFPREFWKSLPVLRDDEFQNNVVVNIAESVSRTPSALRRKVYRTLGLVASDLAERVEKMTEELVMEVEKKAKL

SEQ ID NO: 49 - protein, 473 aa, Claviceps purpurea
MASEVSVASSGSEHSGAQKCPFQDPGLSSMDQDSRLRDILSRFNREKIPERAVHARGAGAYGEFEVTHDVSDICDIDMLLGVGKKTPCVVRFSTTTLERGSAESVRDVKGMAIKHFTQDGNWDWVCLNIPMFFIRDPSKFPDMVHAQRPDPTTNVANPSRWWEFVCNNHETLHMVMFQFSDFGTMFDYRSMSGYAAHAYKWVMPDGSWKYVHWFLASDQGPNFETGHQAKQIGADDAESATRDLYQSLERGEYPSWTVKVQVVDPEDAPKLPFNILDVTKHWNLGNYPPDIDVIPGRTLGKLTLKKGPQDYFEEIEQLAFSPSRLVHGVEASEDPMLQARLFAYPDAQKHRLGPNNLDLPANRTKKLADGSRPEKAEMAPQKVPSQEHADWVSQVKSSSWSEPNETDYKFPREFWKALPRLRGEAFQNSLVVNMAKSVSQVPADMRQKVYSTLALIADDLADRVRTMTEEIVE

SEQ ID NO: 50 - protein, 500 aa, Aspergillus terreus
MAKDDEPKTYRYNETPTYTTSNGCPVFDPQAAQRIGRNGPLLLQDFHLIDLLAHFDRERIPERVVHAKGAGAYGEFEVTDDISDITTIDMLKGVGKKTKTFVRFSTVGGEKGSPDSARDPRGFAVKFYTEQGNWDWVFNNTPVFFLRDPAKFPIFIHTQKRNPQTNLKDATMFWDYLSTHHEAVHQIMHLFSDRGTPYSYRHMNGYSGHTYKWIKPDGTFNYVQIHLKTDQGNKTFNNEEATRLAAENPDWHTEDLFNAIERGEYPSWTCYVQVLSPEQAEKFRWNVFDLTKVWPQSEVPLRRFGRFTLNKNPQNYFAEVEQAAFSPSHMVPGVEPSADPVLQSRLFSYPDTHRHRLGGNYEQIPVNCPLRAFNPTHRDGYMNVHGNYGANPNYPSTFRPIRYEPVKASQEHEKWAGSVVVEQLPVTSEDYVQANGLWQVLGRQPGQQDAFVHNVSVHLCGAHERVRKATYDMFRRVNPDLGARIEKATEANVSAARARL

SEQ ID NO: 51 - protein, 500 aa, Penicillium marneffei
MGKDDEPKTYRYNETPTYTTSNGCPVFDPESSQRIGKNGPLLLQDFHLIDLLAHFDRERIPERVVHAKGAGAYGEFEVTDDISDITTIDMLKGVGKKTKLVTRFSTVGGEKGSADSARDPRGFSVKFYTEQGNWDWVFNNTPVFFLRDPSKFPVFIHTQKRNPQTNLKDANMFWDYLSTHQESAHQVMHLFSDRGTPYSYRHMNGYSGHTFKWIKPDGTFNYVQIHLKTDQGNKTLTNEEAGELSNSNPDWHTQDLFQAIERGEYPSWTCYVQTLSPEQAEKFRWNVFDLTKVWPQSEVPLRRFGRFTLNKNPENYFAEIEQAAFAPSHLVPGVEPSADPVLQARLFSYPDTHRHRLGVNYQQIPVNCPLHAFNPYQRDGAMAVNGNYGANPAYPSSFRAMNFEPVKASQEHENWVGAVISQQIPVTDEDFVQANALWRVLGRTPGQQENFVKNVSVHLCNANERVRKQTYGFFTRINAILGERIKKATEKNVSREHARL

SEQ ID NO: 52 - protein, 503 aa, Ajellomyces dermatitidis
MGADDKFNTYRYNETPTYTTSNGCPVMDPESSQRVGPDGPLLLQDFHLIDLLAHFDRERIPERVVHAKGAGAYGEFEVLDDISDITTIDMLRGVGKKTKLVTRFSTVGGEKGSADSARDPRGFSTKFYTEEGNWDWVFNNTPVFFLRDPSKFPLFIHTQKRNPQTNLKDATMFWDYLSTHQEAAHQVMHLFSDRGTPYSYRHMNGYSGHTYKWIKPDGTFNYVQIHCKTDQGNKTLTNEEATKLSADNPDWHTEDLFRAIERGEYPSWTCYVQVLSPEQAEKFRWNIFDLTKVWPQGDVPLRRFGRFTLNKNPQNYFAEIEQAAFSPSHLVPGVEPSADPVLQSRLFSYPDTHRHRLGVNYQQIPVNCPLRAFSPYQRDGAMAVNGNYGANPNYPSTFRPLAFAPVKASQEHEQWAGAAVSKQFPVTDEDFVQPNGLWQVLGRQPGQQDNFVKNVAAHLCNAQQRVRKATYGMFTRINVDLGNRIEKATEALVAAQGQAQSRL

SEQ ID NO: 53 - protein, 261 aa, Paecilomyces divaricatus
MASVSSRIFAITGGASGIGAATCRLLAQRGAAVICVGDISHGNFDDLKKSIKEINPSTEVHCTSLDVTSVAEVDKWIQSIISSFGDLHGAANVAGIAQGAGMRKSPTIVEETDEEWNKIFKVNLDGVFYCTRAEVRAMKDLPRGSRSIVNVGSIAALSHMPDVYAYGTSKGAAAYFTTCAAADSFPLGIRINGVSPGITDTQLLPQFMPGAKSADEVKEAYEKEGFTIIKPDDVARTIVWLLSEDSTPVYGANINVGAGVP

SEQ ID NO: 54 - protein, 261 aa, Aspergillus fumigatus Af293
MASVESRIIAITGGASGIGAATCRLLAERGAAVLCVCDISPKNFDDLKISIKKINPSTKVHCATVDVTSSVEVRQWIEGIISDFGDLHGAVNAAGIAQGAGMRNTPTIAEEVDEEWTRIMNTNLNGVFYCTREEVRAMKGLPATDRSIVNVGSIASVSHMPDVYAYGTSKGACAYFTTCVAADAFPLGIRINNVSPGVTNTPMLPQFAPMAKTFEEIEESYKKEGLSLIEAEDVARTIVWLLSEDSRPVFGANINVGACMP

SEQ ID NO: 55 - protein, 264 aa, Arthroderma gypseum
MASVTSKIFAITGGASGIGAATCRLLAQREAAALCLGDLSSENMKQLEREIKEINPETKVHCTVLDVSSSSEVDEWVKAIITTFGELHGAANIAGIAQGAGLRQTPTLLEEDDEQWKKVFRVNLDGILYSTRAEVRAMKEYSLTSPGDRSIVNVASIASMAHMPDVFAYGTSKAGCAYFTTCVAQDVMPFGIRANTVSPGITRTPMLPKFVPNAKTQEEVEETYKKEGYSVIEADDVARTIVWLLSEDSRPVFGANINVGACMP

SEQ ID NO: 56 - protein, 264 aa, Trichophyton tonsurans
MASVSSKIFAITGGASGIGAATCRLLAKRGASALCVGDLSSENMKQLEKDIKEINPDTKIHCTILDVSSSSNVDEWIKDIITTFGDLHGAANIAGIAQGAGLRQAPTILEEDDQQWKKVFQVNLDGILYSTRAQVRAMKESSSINPGDRSIVNVASIASMSHMPDVFAYGTSKAGCAYFTTCVSQDVMPFGIRANTVSPGITRTPMLPRFVPNAKTQEEVEETYKKEGFSVIEADDVARTIVWLLSEDSRPVFGTNINVGACMP

SEQ ID NO: 57 - protein, 262 aa, Epichloe typhnia
MASASSKIFAITGGASGIGAATCRLLANRDAAVICVADVVSTNFDSLKKSVHEINQSTLVQCTVVDVASSSAVNKWLEDIVSEHCDLHGAANVAGIAQGAGLRQSPKILAETDEDWSRIMKVNLDGVFYCTRAEVVAMKDLPAGNRSIVNVASIAAFSHVPDVFAYGTSKGACAYFTACVATDVFPVGIRVNCVSPAGVTNTPLLPQFEPNAKSLAEVKSLYESQGFSIVEPEDVARTIVWLLSEDSWPVYGSNINVGASAP

SEQ ID NO: 58 - protein, 261 aa, Claviceps purpurea
MPSMTSKVFAITGGASGIGAATCRLLAERGAAVICLADVSSTNFTSLQESIAKSNPSTLVHCTELDVRSADKVDQWLQSIVSTHGDLHGAANVAGIAQGAGLRATPTILEENDAEWSRILDVNLNGVFYSTRAQVRVMKDLPPGHRSIVNVASIAAFSHVPDVYAYGTSKSACAYLTTCIAADVFWSGIRVNCVSPGITNTPMLPQFEPKAKSLDEIKDMYRDQGYPTGEADGVARTIVWLLSEDSIPVYGANINVGACPP

SEQ ID NO: 59 - protein, 261 aa, Periglandula ipomoeae
MSSVSSKIFAITGGASGIGAATCRLLADRGAAIICLADVSSNNFVSLQESIAEVNPSTLVQCTVLDVSSAVDVNQWLQDIVSIHGDLHGAANVAGIAQGAGLRATPTILEEKDADWSRILDVNLNGVFYSTRAQVRAMKNLPCGNRSIVNVASISAFSHVPDVYAYSTSKNACAYLTTCIAADVFWSGIRVNCVSPGITNTPLLPQFEPKAKSLNEIQEIYRRQGYSTCEAEDVARTIVWLLSDDSRPVYGANINVGACPP

SEQ ID NO: 60 - protein, 261 aa, Metarhizium robertsii
MASLTAKIFAVTGGASGIGAATCRLLAERGAGVICVADVSSTNFDSLQKSIAEINQLTLVQCTVLDVTSSEDVNQWLRDIVSSHGNLHGAANIAGVAQGAGLRTTPTILAETDADWSRILKVNLDGVFYCTRAQVRAMTDLPKGNRSIVNVASIAAFSHMPDVYAYSTSKQACVHFTACVAADVFPLGIRVNCVSPGITNTPLLPQFEPNAKSLDEIQALYASQGLTMCGADEVARTIVWLLSEDSHPVYGANINVGAGVP

SEQ ID NO: 61 - protein, 265 aa, Trichophyton verrucosum
MSFVSSKIFAITGGASGIGAATCRLLAKRGAATLCVGDLCSENMKLLEKDIKKINPDTKVHCTVLDVSSSSNVDEWIQDIITTFGDLHGAANIAGIAQGAGLRQAPTILEDDDQQWKKVFQVNLDGVLYSTRAQVRAMKEFSSTNPGDRSIVNVASIASMSHMPDVFAYGTSKAGCAYFTTFEVTLFALGYFSNIMGMLEGITRTPMLPRFVPSAKTQEEVEETYKKEGFSVIEADDVARTIVWLLSEDSRPVFGANINVGACMP

SEQ ID NO: 62 - protein, 261 aa, Claviceps fusiformis
MSSVSAKIFAVTGGASGIGAATCRLLAERGAAVICVADVNCTDFASLQESIAQINASTLVQCTKVDVSSVQDVNLWLHGIVSKHGDLHGAANVAGIAQAAGLRTKLTILEEDDAEWRRVLDINLNGVFYSTRAEVKVMRDLPLAHRSIVNVASIAAFSHVPDVYAYGTSKNACAYLTTCIAADVFWSGIRVNCVSPGITNTPLLPQFEPKVKTLDEIRKLYREQGYPTSEAEDVARTIVWLLSEDSRPVYGANINVGACPP

SEQ ID NO: 63 - protein, 246 aa, Arthroderma benhamiae
MASVSSKIFAITGGASGIGAATCRLLAKRGAATLCVGDLCSENMKQLENDIKEINPNTKVHCTVLDVSSSSNVDEWIKDIITTFGDLHGAANIAGIAQGAGLRQAPTILEEDDQQWKKVFQVNLDGVLYSTRAQVRAMKESSSTNPGDRSIVNVASIASMSHMPDVFAYGTSKAGCAYFTTCVSQDVMPFGIRANTVSPEEVEETYKKEGFSVIEADDVARTIVWLLSEDSRPVFGANINVGACMP

SEQ ID NO: 64 - protein, 609 aa, Paecilomyces divaricatus
MRYVLLAVAGLLLGWLSFTGKDSRPCRCRPWTSCWPSEETWRAFNKSIDGNLIRLRPIAHVCHEPTFNQSACNELRRFSLDSGWRAAQPGALQDWVWESGSNPDEACLMASPREMPCHQGRVPLFSAAVDSAEQVQRAVRFAKRYNLRLVIRNTGHDGAGQSSGPDSFQIHTHRLQAIQYHTDFQPNGSLVRLGSAVTVGAGVQLGDLYARGSLEGYTVVGGECPTVGAAGGFLQGGGVSSFLSHSWGLAVDNVLEFEMVTAQGDLVVANAHQNQDLFWALRGGGGGTFGVVTRATLRAYHDLPVVVAKLTIAALDADAIFWTKGVTTLLTALQKFNRESVAGQFLLKPQTESGIEASITMYFINETETARVDDRLNPLLTILNSDGITSARSSQFLPRLSMDLRTAPDIYPENYGILMASVLVSNQLFNWSEGPQRMAENFARLPMGPHDLLFTSNLGGRVIANGDVVDTAMHPAWRSAAQLINLVRAVDPSISGKSTALEGLTNIQMPILYSLDPAFRASYLNLADPNEKDSPQVFWGENYGRLLQIKRKWDAGDLFLTKLGVGSDDWEMDGMCRKRQNLINRAFKSVPSQVGKTLWRLLEGSSNDL

SEQ ID NO: 65 - protein, 612 aa, Arthroderma otae
MNSNSQIRSSRLIEALHAYYSKYLVVTIRPIRYLVEPWQPCWPSEELWNSFNTSIDGKLQQLKPAAHVCYEPNFDKGACDDLLRLSRDSGWRASHPGVLQDWVWEAGESANETCPMGSLQTATAAKSCHQGRIPLYSATVESAQQVQQAVRFARRHNLRLVIRNTGHDLAGRSSAPDSFQIHTHRLQETQFHTDLRLNGSTASLGPAVTVGAGVMMGNLYARAAREGYMVLGGDCPTVGVAGGFLQGGGVSDFLSLNQGLGVDNVLEYEIVTADGELLVANTLQNQELFWALRGGGGGTFGVVTRATMRVFPDVPAVISEVLLQAPQTNSSSWTEGLSVILNALQSLNRDDVGGQLVIAVQPELAVQASIKFFFLNSTETTIIDERMKSLLTDLNRIDIQYTLSSKALPHFSSNYRQVPDIHSDNDYGVIGSTVAISKELFDSSQGPQKIARALANLPMSPGDLLFTSNLGGRVISNGEIAETSMHPAWRAASQLLNYIHAVGPSIESRVNALERLTNVQMPMLYAIDPNFRLSYRNVGDPNEKDFQQVYWGSNYKRLSQIKKRWDSDGLFFSKLGVGSELWDSEGMCRKNQSVVRQAVNYLMSFATSMVEG

SEQ ID NO: 66 - protein, 607 aa, Trichophyton tonsurans
MHAYFLPIFGCCNSANSLPGGETQPASCRCRPWESCWPSEELWNSFNTSVDGKLHRLRPAAHVCYGPSFNKSACDNILLLSRDSGWRASNPGMLQDWVWEAGETANESCPVGSLRTASAVNSCHQGRIPLFTVGVESTKQVQEAVRFARKHNLRLVIRNTGHDLAGRSSAPDSFQIHTHRLQEIRFHADMRLDGSNTSLGPAVTVGAGVMMGNLYAQAARHGYMVLGGDCPTVGVVGGFLQGGGISDFLSLNQGFGVDNVLEYELVTADGELVVANALQNQDLFWALRGGGGGTFGVVTRATMRIFPDIPVVISEILLEAPQAISSSWTEGLSIVLTALQSLNRDNVGGQLVIAVLPKLAVQASIKFFFLDVTEAAIIDRRMKPFLTKLSRANVKYTYSSKSLPHFSSNYRQVPDVHSDNDYGVLGSTVAISQQLFDSPQGPEKVANALANIPVSVGDLIFTSNLGGRVIRNGELAETSMHPAWRSASQLINYVHTVKPSIEGRAKARERLTNTQMPMLYALDPNFKLSYRNVGDPNEKDFQQIYWGPNYGRLSDIKKKWDTDDLFFSKLGVGSERWDSEGMCRKSRDALHQKITRFISFPTSIWRG

SEQ ID NO: 67 - protein, 605 aa, Epichloe brachyelytri
MRYLVTFAVGLLLSWGFLSLLQGRPSCRCRPWEACWPNSHQWTSLNASIDGNLVHVQPVGSVCHDPEYDAVACGDVLDLSRNSGWRASNPATLQDWIWETGSGDNESCLLVSSSERSQEIPCHQGRLPLYSAAVKSTAHVQSVVRFAKDHNLRLVIKNTGHDATGRSAAPDSLQIHTYFLKDIHYHDNFFAQGDATGSGPAVTLGAGVVHSEVYKHGIDHKYSVVGGECPTVGIVGGFLQGGGVSSWSGFTRGLAVDNVLEYQVVTANAELVIANEHQNQDLFWALRGGGGGTFGVVTQATVRAFPDDPTVVSTLVLTSTRADTSFWEKAISRLLSILRSCNQQNVHGQLIITRPSEDILNAGLTLHFSNMTNVSHAETLLQPHIASLREEQISAALSCKFVANINSELRLDADIHPRGIGTLQTSMMISDELFGSSEGPSTVAQVFGKLPIGQNDLLFTSNLGGRIAANKALDTAIHPAWRSSAHLVTYVRSVEPSIEAKKLALDEITNKYMPILYSMQPSFKVSYRNLGDPNEKNYQEVFWGEKAYKRLASIKAKLDPDGLFISKLGVGSEDWDAEGMCYQPQNRVSQPLRSLQYFLSVLQDT

SEQ ID NO: 68 - protein, 604 aa, Trichophyton verrucosum
MQFLLWSTGLVALLSWLIYTQETQSASCRCRPWESCWPSEELWNSFNTSVDGKLHRLRPAAHVCYGPSFNRSACDNILLLSRDSGWRASNPGVLQDWVWEAGETANESCPVGSLRTASAVNSCHQGRIPLFTVGVESTKQVQEAVRFARKHKLRLVIRNTGHDLAGRSSAPDSFQIHTHRLQEIQFHADMRLDGSNTSLGPAVTVGAGVMMGDLYAQAARHGYMVLGGDCPTVGVVGGFLQGGGISDFLSLNQGFGVDNVLEYEVVTADGELVVANALQNQDLFWALRGGGGGTFGVVTRATMRVFPDVPVVISEILLEAPQAISSSWTQGLSIVLTALQSLNHDNVGGQLVIAVLPNLAVQASIKFFFLDATEAAVIDRRMKPFLTKLSRANVKYTYSSKNLPHFSSNYRQVPDIHSDNDYGVLGSTVAISQQLFDSPQGPEKVAKALANLPVSAGDLIFTSNLGGRVIRNGELAETSMHPAWRSASQLINYVHTVEPSIEGRAKARERLTNTQMPMLYALDPNIKLSYRNVGDPNEKDFQQIYWGPNYGRLSNIKKKWDTDDLFFSKLGVGSERWDSEESDEVYFFSYFYLEGINTLKVARR

SEQ ID NO: 69 - protein, 605 aa, Neotyphodium lolii
MRHFVTFVVGFLLSWGFLSSLQDPPSCRCRPWEPCWPDSHQWTSLNASIDGNLVHVQPVGSVCHDPHYDAVACGDVLDLSRNSGWRASNPATLQDWIWETGSGDNESCLLVSSSERPQEIPCHQGRLPLYSAAVKSTAHVQGVIRFAKDHNLRLVIKNTGHDATGRSAAPDSLQIHTYFLKDIHYDDNFLVHGDATGSGPAVTLGAGVVHSEVYKHGIDHKYSVVGGECPTVGIVGGFLQGGGVSSWSGFTRGLAVDNVLEYQVVTANAELVIANEHQNQDLFWALRGGGGGTFGVVTQATVRAFPDDPTVVSTLVLSSTRADTSFWVKAISRLLSILRSCNQQNVHGQLIITRPSVDILNAGLTLHFSNMTNVLHAETLLQPHIASLSEDQISTTLTSKFVANINSELRLDADIHPRGIGTLQTSMMISNELFGSSEGPLTVAQVFGKLPIGPNDLLFTSNLGGCIAANKGLDTAIHPAWRSSAHLVTYVRSVEPSIEAKKLALKEITNKYMPILYSMQPSFKVSYRNLGDPNEKNYQEVFWGEKVYKRLASIKAKLDPDGLFISKLGVGSEDWDTEGMCYQPQNRVSQPLRSLKYFLSVLKDT

SEQ ID NO: 70 - protein, 628 aa, Aspergillus fumigatus
MSHRILCVAFCVCSLVAVSSIYSPPFNHPIVYSNNAICFQLSTWRIPQLYLAVLIRRFDLSLSTRGVMLAVTVGVGSSQHHSQRSGLSLTFAMTPSMITLLVKTCVISQRTAVGEPHRPGWVWEVGRTEDETCHAHSPRGAPCHQGRIPLYSAAVESVDQIQVAVRFAQRHRLRLVVRNTGHDTAGRSSGSDSFQIHCHRMKQIEYHDNFRALGSDIDRGPAVSVGAGVTLGEMYARGARDGWVVVGGECPTVGAAGGFLQGGGVSSFHSFIDGLAVDNVLEFEVVTAKGDVVVANDHQNPDIFWALRGGGGGTFGIVTRATMRVHLNSPVCVSEVAVSGLRNNSLLWTKGITGLFSILRSFNQQGIPGQFILRPLSKDQVNASLTLYSLNTDDTRRSAENMLSIRNILESTTLPFTLASRCLPKISDALRKGPDMLPVNYGIITGSVLVSEDLFNSEEGPLHLAKQLEHFPMGPMDLLFTSNLGGNVSANTGKKHRDTSMHPGWRQAAHLINFVRSVSTPTAHEKARSLEELHSVQMRQLYDIEPDFRVSYRNLGDPLESDAAQVYWGPNYKRLLEIKRKWDPEDLFFSQLGVGSEGWTEDQMCKRQQRLQQMLQYLMSSIAQRVYR

SEQ ID NO: 71 - protein, 600 aa, Periglandula ipomoeae
MHRLLGPVACITLAGAVFWAQSGHCRCRPWEPCWPSTAQWEAFNESIQGNLVRIRPIASVCHGLEYDAIACANLSNLIVDSGWRASNPSTLQDWVWESGNVAEEACHIMTSPGEQRGSACHQGRLPLYSAVVQSTSDIQSSVRFASDHNLRLVVKNTGHDCAGRSSSPNSFQIHTNLLKSISFHENFVARGSTTCSGPAVTLGAGVMHWEVYAHGVENGYTIVGGECPTVGAVGGFLQGGGVSSIHSFTKGLAVDNVLEYQVVTPNADLVTANEHENQDLYWALKGGGGGTFGIVTQATVRVYPDDPVVVTATMIKTAFANTLFWTEGVRELLRLLQYFNQLHIPGQLVVTGPEKDSIQATLELHFANMTDEAHAMKLLSSELRPLSIHHISTSTSVRVQKRASSELRMKPDIYPPQYGILQGSVLISTAVFQSAEGPTLIARKFSELTVRSNDILFTSNLGGRVSKNIAIDVPLHPAWREAAQLVTFVRAVGPSIEGKLSALENLTSQDIPILYSVDPNAKISYRNLGDPQEQEFQARYWGLDNYARLAAIKAKWDPNGLFITRSGVGSEDWDVEGICRKSRGLIAQALELLKLGPYIY

SEQ ID NO: 72 - protein, 531 aa, Arthroderma gypseum
MLLLSRNSGWRASNPGVLQDWVWEAGETANETCPVGSLRTVSAVNSCHQGRIPLYSVGVESAQQVQKAVRFARRHNLRLVIRNTGHDLAGRSSAPDSFQIHTHRLQEIHFHTNLRLNGSNASLGPAVTVGAGVMMGNLYSQAARNGYMVLGGDCPTVGVVGGFLQGGGVSDFLSLNQGLGVDNVLEYEVVTADGEIVVANALQNQDLFWALRGGGGGTFGVVTRATMRVFPDVPVVISEILLEASKSNSSSWTQGLSVVLTALQSLNRENVGGQLVIVVLPKLAVQASIKFFFLDATETAAIDHRMKSFLTELSRANVKYAYSSKGLPHFSSNYRQVPDIHADNDYGVLGSTVAISQQLFDSPQGPEKVANALANLPMSPGDLLFTSNLGGRVILNGGLAETSMHPAWRAASQLLNYVHTVEPSIEGRAKAREKLTNIQMPMLYAIDPKFKLSYRNVGDPNEKNFQQVYWGSNYGRLSDIKKKWDTTDLFFSKLGIGSEKWDSEGMCRKHQEAFYQKMRRFISLTTFTLKN

SEQ ID NO: 73 - protein, 595 aa, Claviceps purpurea
MYYLLGPVACFALIASVLWAPSGRCRCRPWEPCWPSAADWHVLNDSLQGSLVRIRPVASVCHGSEYDVAACANLSSLVVDSGWRASNPNTLQDWVWEIGNGVEEFCPYTISPMERRQSICPQGRLPFYSAVVRSTSDIQASVRFASRHNLRLVIKNTGHDSAGRSSAPHSFQIHTSLLQNISLHKNFIARGSTTGRGPAVTLGAGVMQWQAYVHGAKNGYTILGGECPTVGAIGGFLQGGGVSSIHSFTRGLAVDQVLEYQVVSAKGDLITANEDNNQDLFWALKGGGGGTFGVVTEATVRVFSDDPVTVTSTKIEAAAANVLFWKEGVHELLRLLQRFNNLHVAGQLVISAPTKDSLQAGLELHFANLTDETQAIQLLRSEARALETHGISASTSVRVQRKASSELRMKPDLYPPHYGILEASVLISAATFHANDGPALIASKLSGLTLKPNDILFTSNLGGRVSENTAIEIALHPAWREAAQLVTLVRVVEPSIEGKLSALNDLTARDVPILYSIDPAAKISYRNLGDPQEKEFQARYWGADNYARLAATKAAWDPSHLFMTSLGVGSEVWDAEGICRKRRGFRAKASSLIGM

SEQ ID NO: 74 - protein, 500 aa, Arthroderma benhamiae
MLTGVLQDWVWEAGETANESCPVGSLRTASAVNSCHQGRIPLFTVGVESTKQVQEAVRFARKHNLRLVIRNTGHDLAGRSSAPDSFQIHTHHLQEIQFHADMRLDGSNTSLGPAVTVGAGVMMGNLYAQAARHGYMVLGGDCPTVGVVGGFLQGGGISDFLSLNQGFGVDNVLEYEVVTADGELVVANALQNQDLFWALRGGGGGTFGVVTRATMRVFPDVPVVISEILLEAPQAISSSWTQGLSIVLTALQSLNRDNVGGQLVIAVLPKLAVQASIKFFFLDATEATVIDRRMKPFLTKLSRANVKYTYSSKNLPHFSSNYRQVPDIHSDNDYGVLGSTVAISQQLFDSPQGPEKVATALANLPVSAGDLIFTSNLGGRVISNGELAETSMHPAWRSASQLINYVHTVEPSIEGRAKARERLTNTQMPMLYALDPNLKLSYRNVGDPNEKDFQQIYWGPNYGRLSNIKKKWDTDDLFFSKLGVGSERWDSEEQLCLLHA

SEQ ID NO: 75 - protein, 341 aa, Paecilomyces divaricatus
MPTSRIIDIRRSKFEGSIPDQVVDGLTSSPKTLPALLFYSTEGIQHWNRHSHSPDFYPRLEEIRILKKQASVIATSIADNSVVVDLGSATLDKVTFLLEALEAQQKNIDYYALDLSPSELAATLEAVPIHQFHHVRFAGLHGTFDDGLQWLKETPEICDRPHCVLLLGLTIGNFSRQNAASFLRGIAHHALSTSPAQSSILVTMDSCKEPTKVLRAYTADGVVPFALSALKYANSLLRPEDAEIEGGEVFKVDDWYFLSEWNYVLGRHEASLIPQSKDIKLGAPLERIVVRREEKIRFGCSYKYNRAEREELFRSAGVIEDALWSDEGCDVAFYQLKMIPN

SEQ ID NO: 76 - protein, 339 aa, Aspergillus fumigatus
MTISAPPIIDIRQAGLESSIPDQVVEGLTKEVKTLPALLFYSTKGIQHWNRHSHAADFYPRHEELCILKAEASKMAASIAQDSLVIDMGSASMDKVILLLEALEEQKKSITYYALDLSYSELASNFQAIPVDRFHYVRFAALHGTFDDGLHWLQNAPDIRNRPRCILLFGLTIGNFSRDNAASFLRNIAQSALSTSPTQSSIIVSLDSCKLPTKILRAYTADGVVPFALASLSYANSLFHPKGDRKIFNEEDWYFHSEWNHALGRHEASLITQSKDIQLGAPLETVIVRRDEKIRFGCSYKYDKAERDQLFHSAGLEDAAVWTAPDCDVAFYQLRLRLN

SEQ ID NO: 77 - protein, 340 aa, Arthroderma otae
MGNTNPPHILDIRRSKFEESIPKQVEAGLLSSPKTLPALLFYSTEGIQHWNRHSHAPDFYPRHEEIQILKEQATDMAASIADGSVVVDLGSASLDKVIHLLEALEAAQKKVTYYALDLSFSELTSTLQAIPTEQFIHVQFSALHGTFEDGLHWLKETPVIQDQPHCLLLFGLTIGNFSRPNAAAFLRNIASQALTGSPSQSSILLTLDSCKVPTKVTRAYTAEGVVPFALESLRYANTLFPQDGEERVFDPHDWHFLSEWNYILGRHEASLIPQSRDIKLGSPLDRIVVAKHEKIRFGCSYKYDCGERKELFESAGLHDVKIWSKEGCDVAFYQLKCCPN

SEQ ID NO: 78 - protein, 340 aa, Trichophyton equinum
MGSINPPQILDIRRSKFEESIPKQVEAGLLSSPKTLPALLFYSTEGIQHWNRHSHASDFYPRHEEIQILKDKATDMAASIADGSVVVDLGSASLDKVIHLLEALEAAQKKVTYYALDLSFSELNSTLKAIPTDQFVHVQFSALHGTFDDGLQWLKETPFIRDQPHCLLLFGLTIGNFSRPNAAKFLHNIASYALVESPSHSSILLTLDSCKVPTKVIRAYTAEGVVPFALESLKYGNTLFHQDVGENVFDPEDWYFLSEWNYVLGRHEASLVPRSKDIKLGRPLDKIVVGKHEKVRFGCSYKYDSGERKELFETAGLRDVKSWSKEGCDVAFYQLKCCPN

SEQ ID NO: 79 - protein, 344 aa, Epichloe brachyelytri
MSKPNVLDIRLATFEDSIVNLVINGLRKQPKTLPALLFYANEGLKHWNHHSHQPEFYPRHQEVQILKKKAQEMAASIPMNSVVVDLGSASLDKVIHLLEALEVQKKDISYYALDVSASQLESTLAAIPTQNFRHVRYAGLHGTFDDGLHWLKEAPEVRDLPHTVLLFGLTIGNFSRPNAAAFLSNIGQHAFQGKSGDQCSILMSLDSCKVPTQVLRAYTCEGVVPFALQSLTYANSLFGGKNKRQASGDVQHKVFNPDEWYYLSEWNFVLGRHEASLIPRSKDIELPAPLDGIVVGKDEKVRFGCSYKYDQEERMELFAAAGMKNEVTWSDEGCDIAFYELKLS

SEQ ID NO: 80 - protein, 344 aa, Neotyphodium lolii
MSKPNVLDIRLATFEDSIVDLVINGLRKQPKTLPALLFYANEGLKHWNHHSHQPEFYPRHQEVQILKKKAQEMAASIPMNSVVVDLGSASLDKVIHLLEALEVQKKNISYYALDVSASQLESTLAAIPTQNFRHVRFAGLHGTFDDGLHWLKEAPEARDVPHTVLLFGLTIGNFSRPNAAAFLSNIGQHAFQGKSGDQCSILMSLDSCKVPTQVLRAYTCEGVVPFALQSLTYANGLFSEKNKTQASGDVQHKVFNLDEWYYLSEWNFVLGRHEASLIPRSKDIKLLPPLDGILVSKDEKVRFGCSYKYDQEERMELFAAAGVKNEVTWSDEGCDVAFYQLKLS

SEQ ID NO: 81 - protein, 344 aa, Metarhizium robertsii
MASPRVIDIRSSHFEDLLTDQVLSGFSNDPKTLPAQLFYTNEGLEHWNHHSRQPDFYPRQQEIKILKQRGDDMARSIAENSVILDLGSANLEKVTYLLEALEAQEKNVAYFALDLSASQLASTLDSIPTDKFRHVRFTGLHGTFEDGLRWINETPEICDLPHCVLLLGLTIGNFSRQNAAAFLHNIAKNALQGKSRAQSSIVMSLDSCKVPTQVLRAYTSDGVVPFALQALTYANTLFQGKTKNGVNGRQSSCNLDPEDWYYLSQWNFALGRHEASLIPRSKDINLGPLLNDIVVRKDEQVRFGCSYKYDALERTELFTAAGLKDETAWTGEKCDVAIYDLKLS

SEQ ID NO: 82 - protein, 344 aa, Periglandula ipomoeae
MAAPSVIDIRSHLVEDSLPDQVVKGLGSDPKTLPALLFYSNEGLEYWNHHARQPDFYPRHQEIEILKRKGDEIARSVAPNSVILDLGSANLEKVTYLLEALEAQAKNVTYFALDLSAPQLMSTLKAIPTTKFRHVRFAGLHGTFVDGLRWISETPDIRDLPHCVLLFGLTIGNFSRPNAATFLRNIASQALRGASEDKSSIFLSLDSCKVPTQILRAYTSDGVVPFALQSLAYAKTLFCEQTQNDFNEKPSSCHLNPDDWHYHSEWNFVLGRHEASLIPRLNDIHLGPLLHDIVVKKDEKVRFGCSYKYDDLERDKLFVDAGVKDEMAWTNEGCDIAIYELKSM

SEQ ID NO: 83 - protein, 349 aa, Claviceps paspali
MKKTASVTDIRSSRAEDSLPDQVIKGLKSDPKTLPALLFYSDEGLGHWNHHASQPDFYPRRQEIDILKQRGDEMAGSIAANSVVVDLGSANLEKVTHLLKAVEAQEKPVDYFALDVAAPQLTSTLEAMIATTRFRHVGLGGLHGTFDDGLRWLEDTPTIEDRPRCVLLLGLTIGNFSRRNAAAFLRSIANHALRGPAAESSSILVSIDSCKMPTQILRAYTSEGVVPFALQSLTCARRLLLGRGDDDDDAALLSRHLNPDDWYYHSEWNFVLGRHEASLIPRSRDLPLGPLLDNVTVQRDEKVRFGCSYKYDESERETLFSDAGLRCEAVWTNQGCHVAIYQLKLAASL

SEQ ID NO: 84 - protein, 344 aa, Claviceps purpurea
MPALPVIDIRSNHVEDSLPEQIIKGLTSQPKTLPPLLFYSNEGLEHWNHHSRQPDFYPRRQEIEILKQGGNDIARSIAPSSVILDLGSANLEKVGYLLEALEAQEKDVLYFALDISAPQLATTLKEIPSSNFRHVRFAGLHGTFEDGLRWINETPEIRDLPHCVLLLGLTIGNFSRQNAAAFLQNIANHALTGASKNKSSILLSLDSCKVPTKVTRAYTSDGVVPFALQALTYAKALLCDRIDNGIDEKVLSCNLRPEHWHYLSEWNFALGRHEASLIPRFGDVCLGSMLQDIIVKKEEKVRFACSYKYDAKERQKLFLDSGVDQGMVWTNEGCDVAIYELKLA

SEQ ID NO: 85 - protein, 355 aa, Claviceps fusiformis
MPACSVTDIRSHVVEDSLPDQVIKGLKSSPKTLPALLFYSNEGLDHWNHHVSQPDFYPRHQEVDILKQRGDEMARAIAPNSVILDLGSANLEKVVHLLKALEAQGKDVTYFALDISAPQLEVTLNEIPTSEFRHVRFAGLHGTFEDGLRWISETPHICDLPHCVLLLGLTIGNFSRASAATFLGNIASQALRGASKDQSSILMSLDSCKVPTQILRAYTSNGVEPFALQSLTFAKTLLRGPMLHNDSDEPLPCYLQPDDWYYHSEWNFVLGRHEASLIPRYRDVHLGSLLQDITVKKDEKIRFGCSYKYDDMERHQLFLDAGVEQDVAWTNEGCDVVIYELKKRSNTEKLGIDRN

SEQ ID NO: 86 - protein, 290 aa, Paecilomyces divaricatus
MTILVLGGRGKTAQRLASLLDAANIPFLLGSSSTAHVSPFRLSYFNWFEEETYGNPFVQASTEGLDAVSTVYLVGPPVMDMVPPMLKFIDLARSRGVEKFVLLSASTVEKGGHSMGEVHGYLDSLKGVKYVALRPTWFMENLLEEPHLSWIKRQNTIYSATGDGKIPFISADDIARVAFRALTDSNTQATEYLILGPELLSYGQVADILTSVLGRKITHVSLSEPDFTRLLVDEVGLPPDFAAMLAGMEVDVKNGGENRLSNSVKQVTGISPQTFHDFAVKEKQHWTYDG

SEQ ID NO: 87 - protein, 290 aa, Aspergillus fumigatus
MTILVLGGRGKTASRLSLLLDNAGVPFLVGSSSTSYVGPYKMTHFDWLNEDTWTNVFLRASLDGIDPISAVYLVGGHAPELVDPGIRFINVARAQGVNRFVLLSASNIAKGTHSMGILHAHLDSLEDVQYVVLRPTWFMENLLEDPHVSWIKKEDKIYSATGDGKIPFISADDIARVAFSVLTEWKSQRAQEYFVLGPELLSYDQVADILTTVLGRKITHVSLAEADLARLLRDDVGLPPDFAAMLASMETDVKHGTEVRNSHDVKKVTGSLPCSFLDFAEQEKARWMRH

SEQ ID NO: 88 - protein, 293 aa, Paracoccidioides brasiliensis
MTILILGGRGKTSSRLASILSTRAPEIPFIVASRTTSPPSPHKQAIFDWLDESTWGQPFEMASTSSAFTLGPISAVYIVSPPVVDLFPLAKRFIDFAREKGVKRFVLLSASTFEKGGPLMGKVHEYLAGLGEEIAWTVLRPTWFMQNVSEAQFLPFIKGEDKIYSSTGEGKIPFVSTDDIARVAFHALTDERPHNTDHLILGPELLSYGDIADILSSVLGRKITHVSLSEADYVAWLMSATGVSENYAKMLAGLEIPIRNRELEEVNDVVERVTGKAPMTFSEFAEVAKECWL

SEQ ID NO: 89 - protein, 289 aa, Claviceps fusiformis
MTILLTGGSGKTAGHIANLLKEAKLPFIVGSRSSNPHTVERHRTFDWLDEATFNNVLSVDEGMEPVSVVWLVSPPILDLAPPVIRFIDFASSRGVKRFVLLSASTVEKGGPAMGLIHAHLDTIEGVSYTVLRPSWFMENFSTRGEFPCDTIREEDTIYSAAKDGKIPFISVADIARVALRALTAPALHNKDHVLLGPELLTYDDVAEILTRVVGRNIHHVRLTESELAAKLQERGMPADEAAMHASLDSIVEAGAEEKLNTEVKDLTGEEPRHFADFVSDNKNVWLMRD

SEQ ID NO: 90 - protein, 286 aa, Epichloe glyceriae
MTILLTGGRGKTASHIASLLQAAKVPFIVASRSSNSSSPYYQNCFDWLDEKTYGDALTPKEGMQPISTVWLVPPPIFDLAPPMIKFVDFASRRGVERFVLLSASTIEKGGPAMGQVHEYLASLGGIEYAVLRPTWFMENFSYPQELQRLAIKNENKIYSAAGDGELPFVSVADIARVAFRTLTDEKSHNTDYVLLGPELMTYDQVAETLSTVLGRTITHVKLTKDELAKRLENGGMTAEDAEMLAGMDTSISDGAEDRLNNVVKHVTGADPRTFLDFATEQKATWG

SEQ ID NO: 91 - protein, 309 aa, Neotyphodium lolii
MVQIYLPRLSMRLGYHDKNNKMTILLTGGRGKTASHIASLLQAAKVPFIVASRSSDPSSSSPYYQNCFDWLDEKTYGDVLTSKDSMQPISTIWLVPPPIFDLAPLMIKFVDFASRKGVKRFVLLSASTIKKGGPAMGQVHEYLASLGGIEYAVLRPTWFMENFSYPQELQRLAIKNENKIYSAAGDGKLPFVSVADIARVAFRTLTDEKSHNTDYVLLGPELITYDQVAETLSTVLGRTITHIKLTEEELVKRLENSGMPAEDAKMLAGMDTSISDGAEDRLNNVVKHVTGADPRTFLDFATHQKATWG

SEQ ID NO: 92 - protein, 288 aa, Claviceps paspali
MTILLTGGNGKTTRQIARLFEEAKLPFVTASRSPSHPAAKVHRKFDWLDEATFANALSSDDGMKPVSAIWLVAPPVADPAPPVIKFIDLAREKGVKRFVLLSASIIEKGGPAMGSIHAHLDSLAGISYAVLRPTWFMENFSTAGEFQFETMAKENNIYSAAEDGKIPFISTVDIARVAFRALTADSIDAKDLVLVGPELLTYDDVAKTLSKVLGRDITHVRVTEAALAEKRRESGVPADIADMIASMDLIVRSGAEDRMNTAVKDFTGVEPRSFAEFASKEREAWLST

SEQ ID NO: 93 - protein, 290 aa, Claviceps purpurea
MTVLLTGGTGRTAKHIAGIFRQTNVPFLVASRSSSAGTAENHRKFDWLDEETFPNALSVDQGMKPISVVWLCPPPLYDLATPVIKFIDFAVSQNVKKFVLLSASVIQKGGPAMGKIHGHLDSIKDVTYTVLRPTWFMENFSTKGEIQCEAIRRDSTVYSATENGKIPFISVVDIARVAACALTAETLKNSDHILQGPDLLTYDEVAQALTGVLGRKITHTKMTEGELAEKLMEEGVTPEEAYMHAAMDSMIKSGSEERVVSDEVKEWTGVKPRGFINFALSEKAAWRARK

SEQ ID NO: 94 - protein, 308 aa, Metarhizium robertsii
MTILLTGGRGKTASHIAALLDAANLPFAIASRSCSHDSKYRQLRFDWLDDTTYDNVLSPKDGMQPISAVWLVPPPIADLAPPVNAFINHARLKDVKRFVLLSASMLERGAPAMGQIHEHLASMEGIHYTVLRPTWFMENFSSPHEFQCKAIRKEDKIYSAAENGKVPFISVVDIARVAFRALKGDVEENIDPILLGPELLTYDDVSTCKGLRDASPDTDKRVKVAETLSKQLNRKINHVRLEESELAEKMHEYGMPLEDAQMHASMDLIVRAGGEERLNKTVLELTGTTPRTFQEFASSEKDIWLLKN

SEQ ID NO: 95 - protein, 289 aa, Paecilomyces divaricatus
MTVTKTSKPVLRRLPISAGADAIFQVLQEDGVLIIEGFLTPEQVKKFNAEVDPHLKKWELGQGSMQEGYLANMKQLSSLPLFSKTFRDDLMNHDLLHGICKKAFGPDSGDYWLTTSSVLETDPGYPGQDLHREHDGIPICTTLGRDSPEAMLNFLTALTDFTEENGATRVLPGSHLWEDYSKSVSPDQAIPAEMNPGDAVLFSGKTLHGAGKNQSKDFLRRGFPLIMQSCQFTPVEASVAIPRSLVETMTPLAQKMVGWRSVSAKGVEIWTYDLKDLAKGLKLKAIAAE

SEQ ID NO: 96 - protein, 298 aa, Botryotinia fuckeliana
MTVSVPTPFRRISAKAPVEEILQMFREDGGIVVEDFFTQEQMANINKEVDPLLAKIKCGTHRDVGEEEWITQFHGSNTRRLSNLPTISKTFREEVLNYDLLHQICEAIFRKESGDYWMCTAQVIEIGPQSKAQELHRDTAEFPGLTKLGPRMDEIQISFFTALTDFTAENGATRGIPKSHLMEDYEDWGREEDAVPAVMKTGDVFFFTGRLCHGGGENRTEDFWRRGISLCFQASYLTPEECYPLMIPRDVIESMTPLAQKMCAWRSQYPTLGGGLWQHNYTEVADQIGLKSNQPLKL

SEQ ID NO: 97 - protein, 613 aa, Chaetomium globosum
MPSFVTPAILINNSTSYPLLLITALEDTGILDSLIVTDETAKQAIERAKAYLLVYSTISNCVTFAVGPRLIDSEHAADDEDDEDDKTGNGNRGRDGHTAASTPDVEANEETRLLDSQLPNSPHPLRRSSFSFSLPSKSGKPTSKPDHRRPWFMSPQRWNRLSSQTKWWFLFILDFFNAPLLGAIVGAVVGLVPPFHRAFFNSSDDGGIFTAWLTSALKQIGGLFVSLPVVVAGITLFCSTKEARANNESGMNLPLGTTLYILFVRFIAWPAVSISVIYVLAAKTSLLGSDPVLWFCLMMMPEWTKRHEAHHPRFRWLREPRRLLSLHGKMPATPKLQQVKPSEGRDAVFRALREDGAVIIKGLFTKDQVRRLNHEVQPAMDKIGVGSKQSEEWLKDFHGDKTKRLNGVVALSETFRHEILENDLIHELCEEIYLQDAGGYWMNSAQVIDIGPGSKAQPLHRDQWQFPIFTYSGPDAPEASVNFVVALTEFTDENGATRVIPGSHRWQDLQQNGTPEDTIPAEMEVGDACFITGKVVHGGGANRTKDFTRRAITLVFQCSYLTPEEAYPFIVSKEIAKTLSPRGQRMIGFRSQFLKDSPGVWKRDYGEVDEAYC

SEQ ID NO: 98 - protein, 286 aa, Aspergillus terreus
MTGQAEAIRRVHPTVSPKQAAQMLQEDGVIILKSFLAPDVMQRFQAEVDEDVEKTSTGARMKAYKLVNDKTKHMADLIVRSEVFRSDILTHPLYHAIADELFRADYGDHWLNASAVLQLMPGAPAQQLHRDEEIFAASKFRSPTDPQLSLSCLVALTEFTEENGATRLIPGSHLWDSAHPAPSPDQTVPAIMQPGEAILFLGSLFHGGGENRTENVRRGLGMSLIPCQFTPYSSHMHVPRTIIETMTPLAQKLVGWRTVESHRQYPFWQGGDRRLEDVLGLASREA

SEQ ID NO: 99 - protein, 297 aa, Neosartorya fischeri
MTVPDNSSKPQIQRVPADADPNAIRQLLEEDGAAIIEGVFSEDIIQSFNQDLNPAATAAEMAAKTNYEFQFPQQSKYVFNLPGKSATFRNDILNSPVLHGLAKSVFAETGDYWLTASFLRELHAGHNPQELHRDESTHPLLRSLKLGAPPLAISFILALTDFTKDNGGTRVILGSHKWPEIGNPRPDQTVSTEMKAGDVLVLAQGMVHGGGAHPEDLPEARRAVLVFFSSCQLTPFETFMTMPREIVETMTPLAQQMIGWRSAKPGPPNVSGLHTSDSKLLEDALQLRANQSQGKGL

SEQ ID NO: 100 - protein, 298 aa, Uncinocarpus reesii
MVAIGDSKPQIKRFPVSENPETIWKVVEEDGAAIVEGWLSPDVVQRFNQDLDVRSAKTPGGTMNEEFYTMPLPKTTKWMNDLPATCKTFRHDILNNPILHDICKIAFKEHGDYWLLNGMAMEMAPGNPIQQIHRDQGTHPILKYIKPGSPVPAISIITALTEFTEFNGATRVILGSHRWERIGDPSPDLAVRAVMKPGDAMIMYQGTVHGGCPHDEGNPEHRRLLLLGMGTCQLTPYETHMTMPRRIVESMTPLAQKMIGWRSVRPVISNVTGLMTVRMKHLERQIELKSDVPLEEER

SEQ ID NO: 101 - protein, 300 aa, Trichophyton rubrum
MSEQIIERFPVSAGPDAIFESFKKNGVVVIENFAKKDQLDRFTAEIDPALQKLTAGYASRIDGDEPVDEFFGKKTKRLGQLSTVSSVFRHEFLEHDLMHSLLERNFIDYPLAGYWMNTSDVIEIGPGSKPQPIHRDLELYHPFVIGGPAMPEAICNFMVALTPFTAENGATVFAPGTHLNESFERLEDGGLPGGDKTISAVMNPGDCAFFSGKVIHGGGTNSTTDEFRRGLSMSFIRKILSPEQAHPLSISREIVETMSYRGQAMLGFRSNWPAIGDEPAIIWSYQGSDIGKKLGLGDKN

SEQ ID NO: 102 - DNA, 1440 bp, Artificial Sequence
  DmaW of A. japonicus with alternative C-terminus codon optimized for S. cerrevisiae
atgactgctggtcaaggtattaagactggtaatgcttctgattgcgaagtctacagaactttgtctgttgctttggatttcgccaatcaagatgaagaattgtggtggcattctactgctccaatgtttgctcaaatgttgcaatctaccaactacaacttacacgctcagtacaagcacttgttgatctacaagaagaacgtcattccattcttgggtgtttacccaactaatgataagccaagatggttgtccattttgaccagatatggtactccattcgaattgtctttgaactgttctggtccattggttagatacacttacgaacctattaacgctgctactggtactgctagagatccattcaatactcatgctgtttgggactcattggaacaattgatggctttacaatccggtatcgatttggatttgttcagacacttcaagaacgacttgactttgtctgctgaagaatccgaatacttgtacaagaacaacttggtcggtgaacaaatcagaacccaaaacaaattggctttggacttgcaagatggtgaattcgttgttaagacttacatctacccagccttgaaatctttggctactggtagaagtatccacgaattggtttttggttctgctttcagatggtctaagcaatacccagaattgagaaagccattggataccttggaacaatacgtttattctagaggtccatcttctactgcctctccaagattattgtcttgcgatttgattgaccctaccaagtccagaatcaaaatctacttgttggaaagaatggtcactttggaagccttggaagatttgtggactatgggtggtgaaagaactgatgcttctactttggctggtttggaaatgattagagaattgtgggaattgatcagattgccagctggtttacaatcttatccagctccatatttgccaatcggtactattccagatgaacaattgccattgatggccaactacaccatccatcatgatgatccagttccagaaccacaagtttactttactactttcggtagaaacgacatgcaaattgctgatgctttggctactttcttcgaacgtcgtggttggcacgaaatggctagacagtacaaagctgaattgtgctctcattacccacatgctgatcacgaaactttgaactacttgcacgcttacatctcattctcttacagaaagaacaagccatacttgtccgtctacttgcaatctttggaaactggtgattgggttacctcatccttcaactctgtccatgtggaccctggcctttcagccaccgtccaagagctgtccaagctgaccaagaccgccggaaccaccgttagggagacaaaactaccactaaccccagatggatcagagcctggcgtcatcacccagtactag

SEQ ID NO: 103 - DNA, 1239 bp, Artificial Sequence
  EasA of A. japonicus codon optimized for S. cerrevisiae
atgaccatcgatccatcttctccaggtgctccagcttctaagttgtttcaacctatgaagattggtttgtgccacttgcaacatagattgattatggctccaactaccagatacagagctgattctactgctactccattgccattcgttcaagaatattatgctcaaagagctgctgttccaggtactttgttgattactgaagctaccgatatttctccacaagctgctggtgaaccacatattccaggtctatattctgctactcaaattgctgcttggagaggtatagtttctgctgttcatagaagaggttgctacattttctgtcaattgtgggctactggtagagcagctgatcctgctttgttgaaagaaaaaggtttcccattggtcagttcctccgatgttccaattgaaactgaatctcaacaaccacaaccattgacccaagctgaaattgaaggttacattgctgatttcgttaccgctgctagagttgctgttcatgaagttggttttgatggtgttgaattgcatggtgctaacggttacttgattgatcaattcactcaatggccatgcaatcaaagaactgattgctggggtggttctattgaaaacagagctagatttgctttggctgttactagagctgttgttgatgctgttggtgctgaaagagttggagttaagttgtctccatggtcacaatatgctggtatgggtgttatggctgatttggttccacaattcgaattcttgattaagagattgagagaagagtacaacgacggtccaggtttggcttacttgcatttggctaattctagatggttggacgaagaaacttctcatccagatccacatcatgaagtttttgttagagcttggagaggttctggtagagatggtattgaagctaaaaaagaagccccaccagttattttggctggtggttatgatgctgtttctgctccagaagttgctgacaaggttttcaaagaagaagataacgttgctgttgccttcggtagatactttatttctactccagatttgccattcagaatgcaaagaggtattccattgcaaaagtacgatagagcttctttctacacctccttattgaaagaaggttacttggactatccatactccgctgaatatgttgctgaattcggtcaaagattgaagaagaaagaagctgctgctaccggttctatttgtcaaggttaa

SEQ ID NO: 104 - DNA, 1530 bp, Artificial Sequence
  EasC of A. japonicus codon optimized for S. cerrevisiae
atggctccagattctaagccaacttacactactgctaatggttgtccatttcataagcctgaaggtccaccagctgatggtagaactttggctttgtctgatcatcatttggttgataccttggcccatttcaacagagaaaagattccagaaagagttgttcacgctaaaggtgctggtgcttatggtgaatttgaagttactgccgatatctccgatatttgcgatatcgatatgttggttggtgtcggtaaaaagactccatgtgttactagattctctaccactggtttggaaagaggttctaacgaaggtatgagagatttgaaaggtatggcttgtaagttctacactactgaaggtaattgggattgggtcatgttgaatttcccattcttcttcattcgtgatccagtcaagttcccatctttgatgcacgctcaaagaagagatccacaaactaatttgttgaacccaaacatgtactgggattgggttaccaacaatcatgaatccttgcacatggtcttgttgcaattttctgatttcggtactatgttcaattggagatccatgtctggttatatggctcatgcttacaaatgggttaagccagatggttcttttaagtacgtccacatcttcttgtcatctgatagaggtccaaatttcaccgatggtcaacaagctaaaggtacaaatgatttggatccagatcacgctactagagacttgtatgaagctattgaaagaggtgaatacccaacttggactgcttctgttcaagttgttgatccaaaagatgctccaaacttgggttacaacattttggatgttactaagcactggaacttgggtacttacccaaaagatgttactttgatcccaccaaaggttttcggtaagttgactttgaaaagaaacccagctaactacttcgccgaaattgaacaattggcttactctccatctaacatggttccaggtgttgctccatctgaagatccaattttacaagctagaattttcgcttacccagacgctcaaagatatagattgggtgctaaccatcaacaaatcccagttaatagatccgctcatacctttaacccaattgctagagatggtcaaggtacttttgatgctaattatggtgctcatccaggtttcttgactcaacaacaaccagttagatttgccgaacctagagaaccagatccaaagtataatgaatggttgaaagaaatccaatccaagtcctggttgcaaactactgaacatgattacaagttcgccagagatttctacgaagttttgccagattttagaggtcaagaattccaagataccatggtccaaaacatggttgaatctgttgctcaaaccagagccgaaattcaaaagcaagtttacgaaacctggaagttggtttctccagctttggctgctagaattcaaaaaggtgttgaaaccttgttgcaaaagtctgaagctccagctgaagaatcttttattccagctagattgtga

SEQ ID NO: 105 - DNA, 789 bp, Artificial Sequence
  EasD of A. japonicus codon optimized for S. cerrevisiae
atgaccgttgtcaactctagaattttcgctgttactggtggtgcttctggtattggtgctgctacttgtagattattggctgctagaggtgctgctgttatatgcattggtgatatttctccaaagggtttcgaatccgttacctctgatattcaagccttgaatccagctacaaaggttcattgcactagattggatgtttcttcatccgctgaagttgatgcttggttgcaaactatcgttcaaacttttggtgacttgcatggtttggctaatgttgctggtattgctcaaccagctggtgctagacaagctccagctttgttggaagaaactgatgaagaatggcaaagagttttcaaggttaacttggacggtgttttctactgtactagagctggtattagagctatgaaggctttgccaggtccaaaagatagagctatcgttaacattggttccattgctgcctttatccatttgccagatgcttatgcttacggtacttctaaaggtgcttgtgcttactttacttcttgtgctgctatggatgcttggccattgggtattagaatcaattctgtttctccaggtattaccgatactccagctttgccacaattcatgccacaagctaaatctatcgacgaagtaaaagaagcctacatcaaagaaggtttcccaatcattcaacctgaagatgttgctagaactatcgtctggttgttgtctgaagattctagaccagtttacggtgccaatattaacgttggtgctgcaactccataa

SEQ ID NO: 106 - DNA, 1866 bp, Artificial Sequence
  EasE of A. japonicus codon optimized for S. cerrevisiae
atgggtcaatccagaggtattttgggtggtgttagacaattgatcttggttattttggttggtgcctacttgtctagattgtctgctgttgatgatgatagacatgattgcagatgtagaccaggtgaaccatgttggccaactgtttctcattggtctactttgaacgaatctattggtggtgctttggctcatgttaagccaattgctcatgtttgtcatcaatccggtcaagattcttctgcttgcgaacaagttttacaagaatccttggattctaagtggcgtgcttctcatactggtgctttacaagattgggtttgggaaggtggtgctgaatctaatcaaacttgttactacttgagatcaggtccagctggttcttgtcatcaaggtagaattccattatattccgctgctgttaagtccgcttctgatgttcaaaaggttgttgatttcaccagacaacacaacttgagattggttattagaaacaccggtcatgatggttctggtagatcatctggtccagattctgttgaaattcatacccatcacttgaactccgttcaataccatccaaattttagaccagctggttcctctgaaagacaatctgctccaggtcaaccagctgttactgttggtgctggtattttgttgggtgacttgtatgctagaggtgcttctgaaggttggatagttgttggtggtgaatgtccaacagttggtgctgctggtggttttttacaaggtggtggtgtttcttcttggttgtcttatgctcatggtttggctgttgataacgtcttggaatacgaagttgttactgctaagggtgaaatcgttattgctaacgctcatcaaaacccagatttgttttgggctttgagaggcggtggtggtggtacttttggtgttgttactcaagctacattgcaagttcatccagatttgccagtttctgttgctgatgctgttgttactggttctagagctgatgctactttttggtcacatggtgttgctgctttgttgagagctttacaattcttgaacaaccatggtactgccggtcaattcattttgagaaacactgatgatgataccgtccaagctagtttgactatgtacttctctaacttgactgttccagctgttgctgacgaaagaatggatcctttgagaagagctttggaacataatggtcatccataccaattgacctctagattcttgccacaaatctcttctactttcagacataccgctgatagatacccagaagattacggtattttgatgggttccgttttggtttccttggacttgtttaattctgctactggtccagctgctttggcacaacattttgctagattgccaatgactccagatgatttgttgttcacttctaacttgggtggtagagtctcttcattgaatagagatccagcttctactgctatgcatccaggttggagagatgctgctcaattattgaatttcgttagaggtgttggtgctccatctttggctgctaaagctactgctttacatgaattgcaaaccgttcaaatggccagattatacgaaattgaaccagccttccaaatctcctacagaaatttgggtgatccatccgaaagaagatccagagaagtttattggggttctaactacgctagattggttgaagttaagagaagatgggatccagaaggtttgttcttctccaaattgggtattgatggtgatgcttgggatgctgaaggtatgtgtagacaaacaagacaaggtgcttggaatgttgctgttaagtgggttcaatctttcttgggttctttgtctgcttccgttgtttga

SEQ ID NO: 107 - DNA, 1020 bp, Artificial Sequence
  EasF of A. japonicus codon optimized for S. cerrevisiae Af_optSc
atgacaatttctgctccacctattattgatattagacaagcagggttggaaagttctataccagaccaagttgtcgaaggtctaactaaggaagtcaagacacttcctgcacttttgttttactcaacaaaaggcattcagcattggaatagacattcccacgctgctgatttctatcctagacatgaggaactatgcatcctcaaagctgaagctagtaagatggctgcttcaatcgctcaagatagcttagtaatcgatatgggttctgccagtatggataaggttatcctcctgttggaagcgttagaggaacagaaaaagtccataacttactacgccttggacctgtcctactctgaattagcatctaattttcaagccattccagtggacagattccactatgttagattcgcagccttacatggcacttttgacgatggacttcactggttacaaaacgctcctgatattaggaacagaccaagatgtatactgttatttgggttaaccatcggtaacttctcacgagataatgctgcatctttcctcagaaatatcgcccaatctgctctgtctacatccccaactcaatcatccattatagtgtctctagattcatgtaaacttcctacgaaaatcttaagagcctacaccgcagatggagtagttccatttgctcttgcctcactaagctatgcgaattcattgtttcatccaaaaggcgacagaaagattttcaatgaagaggattggtactttcattctgaatggaaccatgcattgggtcgtcacgaagctagtttgatcacacaatcaaaagatatccaattaggtgcaccactagagactgttatagtcagacgtgatgaaaagatcagatttggatgctcttacaaatacgacaaagctgaaagggatcagttgtttcattcagcgggtttggaggatgccgcagtgtggacagcaccagactgtgacgtagcattctatcaattgagactaagattgaactaa

SEQ ID NO: 108 - DNA, 855 bp, Artificial Sequence
  EasG of A. japonicus codon optimized for S. cerrevisiae
atgaccatcttggttttgggtggtagaggtaaaactgcttctagattgtctgctttgttgcatgaagctcaaatcccttttgttgtcggtacttcttctactgctccaattgctacttatagaaccgctcattttgactggttgaacaaggatacttggactaatgcttgggatcaagctccagaacctattactgctatctatttggttggtgctcatgctccagaatttgttcatccaatgttcgaattcatcgatttggctcattctagaggtgttagaagatacgctttggtttctgcttctaacactgaaaaaggtgatccaatgatgggtgaagctcatgctcatttggattctaaagaaggtgttaagtacgtcgtcttaagaccaacttggtttatggaaaaccacatcgaagatccacatttgtcttggattaagaccgaaaacaaaatctactctgctactggtccaggtaagattccatttgtttctgctgatgatattgccagagttgcttttcatgctttgactcaaccattgacccaaaaagaacaacaatatatggttttgggtccagacttgttgtcttatgctgatatggctgaaatcttgaccgatttgttgggtagaaagattacccatgttactttgccagctgaaaagttcggtcaattcttggttgatactgctggtttgccaccagattttgctgaaatgttggctactatggaagctgctgttgctactggtgctgaagaaagagtttctcaagacgttgaaaaggttactggtagaccacctagaagatttgttgattacgctagagaaaacagagaacattggttgtaa

SEQ ID NO: 109 - DNA, 882 bp, Artificial Sequence
  EasH of A. japonicus codon optimized for S. cerrevisiae
atgaccattaccgaaacttctaagccaaccttgagaagaattccaagatcagctggtgatgaagctattttccaagtcttgcaagaagatggcgttgttgttatcgaaggtttcatgtctgctgaccaagttagaagattcaacggtgaaattgatccacacatgaagcaatgggaattgggtcaaaaatcctaccaagaatcttacttggctggtatgagacaattgtcatctttgcctttgttctccaagttgttcagagatgaattgatgaacgacgaattattgcacggtttgtgcaagagattattcggtccagaatctggtgattactggttgactacttcttctgttttggaaactgaaccaggttaccatggtcaagaattgcatagagaacatgatggtattccaatctgtactaccttgggtagacaatctccagaatctatgttgaacttcttgactgctttgactgatttcactgctgaaaatggtgctactagagttttgccaggttctcatttgtgggaagatttttctgctccaccaccaaaagctgatactgctattccagctgttatgaatccaggtgatgctgttttgtttactggtaaaactttacatggtgccggtaagaacaacactactgattttttgagaagaggtttcccattgatcatgcaatcttgtcaattcactccagttgaagctagtgttgctttgccaagagaattggttgaaactatgactccattggcccaaaaaatggttggttggagaactgtttctgctaagggtgttgatatttggacctacgatttgaaggatttggctaccggtattgacttgaagtctaatcaagttgctaagaaggcctaa

SEQ ID NO: 110 - DNA, 1801 bp, Artificial Sequence
  P/A cassette including both Asc I sites
ggcgcgccatgcagggatatcagatctacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcgcatgcccatgggttaactgatcaatgcatcctgcatggcgcgcc

SEQ ID NO: 111 - DNA, 1746 bp, Artificial Sequence
  G/C cassette including both AscI sites
ggcgcgccatgcagggatatcagatctcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacggacacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggcacgtccgacggcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcaagctgcatgcccatgggttaactgatcaatgcatcctgcatggcgcgcc

SEQ ID NO: 112 - DNA, 2432 bp, Artificial Sequence
  pUC18 into which an Asc I site (SeqID 113)  was inserted into the Pvu II sites
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctgatttgcccgggcagttcaggctcatcaggcgcgcctgatgagcctgaactgcccgggcaaatcagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 113 - DNA, 74 bp, Artificial Sequence
  Linker inserted into Pvu II sites of pUC18, containing an Asc I site
cagctgatttgcccgggcagttcaggctcatcaggcgcgcctgatgagcctgaactgcccgggcaaatcagctg

SEQ ID NO: 114 - DNA, 10062 bp, Artificial Sequence
  pEVE2294 (YORW?17-KanMX-G/C+Aj_DmaW_altC-P/A+Af_EasF)
cggtgcgggcctcttcgctattacgccagctggcgaaagggggatgtgctgcaaggcgattaagttgggtaacgccagggttttcccagtcacgacgttgtaaaacgacggccagtgaattcgagctccctgcaggtgtgcacaaaggccataatattatgtctacagaatatactagatgtcctccctataggatatagtaatcctctaaatggaaccgatatttctacataataatattacgattattcctccttccgttttatatgtttcattatcctagcacactatcaatctttgcatttcagcttccattagatttgatgactatttctcaatctttatgttatctccttacgccgcatgtgataatatactgctagtatgactactagttgatagaagatagttgatttttactccaacaaaagtaacaatattatttagaactatagattccattttgtgcattcccatattctcgaggaaaacttttagtatattctgtagacataatattatcgcctttgtgaacaatagaatcccaacaattgtcgcaaatttaccaattttctagattgcagtcaccttttcaattaatcactagtgtttcacttgtaacattgtcgttgttgtttaacgtattctgtcccgtgccaactatgacaaaaatgcaatgatttcagcggttaaatacgaagcgcaacaagagttagcgaaaaataagtaccaccattctacgctaccattacttactgaaattagagacaactgttatctattggcagatgttcatacggggctttcaaatattgatgaaattatgtgatgtttagaagaagattcgaactgttttcagtagatttggtaactgtgcaaccataactcatgccgcggccgcataggccactagtggatctgatatcacctaataacttcgtatagcatacattatacgaagttatattaagggttctcgagagctcgttttcgacactggatggcggcgttagtatcgaatcgacagcagtatagcgaccagcattcacatacgattgacgcatgatattactttctgcgcacttaacttcgcatctgggcagatgatgtcgaggcgaaaaaaaatataaatcacgctaacatttgattaaaatagaacaactacaatataaaaaaactatacaaatgacaagttcttgaaaacaagaatctttttattgtcagtactgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgaggcaagctaaacagatctctagacctaataacttcgtatagcatacattatacgaagttatattaagggttgtcgacctgcagcgtacgaagcttcagctggcggccgcggcgcgccagcttgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaagggggacggatctccgaggcctcggacccgtcgggccgccgtcggacgtgccgcggctagtactgggtgatgacgccaggctctgatccatctggggttagtggtagttttgtctccctaacggtggttccggcggtcttggtcagcttggacagctcttggacggtggctgaaaggccagggtccacatggacagagttgaaggatgaggtaacccaatcaccagtttccaaagattgcaagtagacggacaagtatggcttgttctttctgtaagagaatgagatgtaagcgtgcaagtagttcaaagtttcgtgatcagcatgtgggtaatgagagcacaattcagctttgtactgtctagccatttcgtgccaaccacgacgttcgaagaaagtagccaaagcatcagcaatttgcatgtcgtttctaccgaaagtagtaaagtaaacttgtggttctggaactggatcatcatgatggatggtgtagttggccatcaatggcaattgttcatctggaatagtaccgattggcaaatatggagctggataagattgtaaaccagctggcaatctgatcaattcccacaattctctaatcatttccaaaccagccaaagtagaagcatcagttctttcaccacccatagtccacaaatcttccaaggcttccaaagtgaccattctttccaacaagtagattttgattctggacttggtagggtcaatcaaatcgcaagacaataatcttggagaggcagtagaagatggacctctagaataaacgtattgttccaaggtatccaatggctttctcaattctgggtattgcttagaccatctgaaagcagaaccaaaaaccaattcgtggatacttctaccagtagccaaagatttcaaggctgggtagatgtaagtcttaacaacgaattcaccatcttgcaagtccaaagccaatttgttttgggttctgatttgttcaccgaccaagttgttcttgtacaagtattcggattcttcagcagacaaagtcaagtcgttcttgaagtgtctgaacaaatccaaatcgataccggattgtaaagccatcaattgttccaatgagtcccaaacagcatgagtattgaatggatctctagcagtaccagtagcagcgttaataggttcgtaagtgtatctaaccaatggaccagaacagttcaaagacaattcgaatggagtaccatatctggtcaaaatggacaaccatcttggcttatcattagttgggtaaacacccaagaatggaatgacgttcttcttgtagatcaacaagtgcttgtactgagcgtgtaagttgtagttggtagattgcaacatttgagcaaacattggagcagtagaatgccaccacaattcttcatcttgattggcgaaatccaaagcaacagacaaagttctgtagacttcgcaatcagaagcattaccagtcttaataccttgaccagcagtcattttaagctttttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgtccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaaagcttaaaatgacaatttctgctccacctattattgatattagacaagcagggttggaaagttctataccagaccaagttgtcgaaggtctaactaaggaagtcaagacacttcctgcacttttgttttactcaacaaaaggcattcagcattggaatagacattcccacgctgctgatttctatcctagacatgaggaactatgcatcctcaaagctgaagctagtaagatggctgcttcaatcgctcaagatagcttagtaatcgatatgggttctgccagtatggataaggttatcctcctgttggaagcgttagaggaacagaaaaagtccataacttactacgccttggacctgtcctactctgaattagcatctaattttcaagccattccagtggacagattccactatgttagattcgcagccttacatggcacttttgacgatggacttcactggttacaaaacgctcctgatattaggaacagaccaagatgtatactgttatttgggttaaccatcggtaacttctcacgagataatgctgcatctttcctcagaaatatcgcccaatctgctctgtctacatccccaactcaatcatccattatagtgtctctagattcatgtaaacttcctacgaaaatcttaagagcctacaccgcagatggagtagttccatttgctcttgcctcactaagctatgcgaattcattgtttcatccaaaaggcgacagaaagattttcaatgaagaggattggtactttcattctgaatggaaccatgcattgggtcgtcacgaagctagtttgatcacacaatcaaaagatatccaattaggtgcaccactagagactgttatagtcagacgtgatgaaaagatcagatttggatgctcttacaaatacgacaaagctgaaagggatcagttgtttcattcagcgggtttggaggatgccgcagtgtggacagcaccagactgtgacgtagcattctatcaattgagactaagattgaactaaccgcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcacgcgccaatcgtccccaacaaaagtgggctctcaaaattcatcacatttaaatgcatataggaagagcaacagttggtttgcatctgatgttccttaaagatttcgacataatgtgcgaagtagataaaatgggtcatttattaatagttatttcattattaaccagttgtggtacaaatgcaactaaagaaaaaaactactaaactatccgggaaatgcgccttagattgcacttcttaattcttattttcgatttttatttttcctttgataatcataaagagaaacgacgatcatttctaaagccatttctgctagtataccgttaaataagaaaaataaagccaaatattataatttttctaatgtgaatccataaatatcaaagcatgcaaaaagggaaagaagtaatgtcttggatttatatagcgtatttgtctaaggggagccagctttcctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgat

SEQ ID NO: 115 - DNA, 11142 bp, Artificial Sequence
  pEVE2312 (YPRC?15-HygR-P/A+Aj_EasC-G/C+Aj_EasE)
cggtgcgggcctcttcgctattacgccagctggcgaaagggggatgtgctgcaaggcgattaagttgggtaacgccagggttttcccagtcacgacgttgtaaaacgacggccagtgaattcgagctccctgcagggccaggcgcctttatatcatataattaagacacaaaaggataaaacaaaggtgttaactattctgcatactcactatcgtaaactgtcctgcaaatcgtgtaaatatgtatttcattttttttgcagtgaaaaaaggcatgtaaaataccgcatcaagtaactctactccgcctgtggtttcaagactaacggcttgagacaaaatgggaagaaatgattgcagaaaagccatatgtgtaatagcaaaaagctggatagtgcttaccagatgtttaccttaatttcttggtgaattagagaagtacagaagttttactattaatcccaccatagaaatttgtataggaaagtagtttattggagttattggatatactgtgtaaactatttcttgaaattgtaatcttaagatgctcttcttattctattaaaaatagaaaatgattttcatatttatttatttatttatattttggcattactcttcatcatttttttccctctaagaagcttcctttctttttataaggataacaaaaccaaaaggaatattgggtcagatgaatggacgcgaatgcaagacagaagtccaaatcacgtcaagacaaagaaagaaagaaagaaaaactaacacattaatgtagttttaaaatttcaaatccgaacaacagagcatagggtttcgcaaagcggccgctaacttcgtataatgtatgctatacgaagttatttcgacactggatggcggcgttagtatcgaatcgacagcagtatagcgaccagcattcacatacgattgacgcatgatattactttctgcgcacttaacttcgcatctgggcagatgatgtcgaggcaaaaaaaatataaatcacgctaacatttgattaaaatagaacaactacaatataaaaaaactatacaaatgacaagttcttgaaaacaagaatctttttattgtcagtactgattattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttcgttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacctaacttcgtataatgtatgctatacgaagttattaggcggccgcggcgcgccgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcggtcacaatctagctggaataaaagattcttcagctggagcttcagacttttgcaacaaggtttcaacacctttttgaattctagcagccaaagctggagaaaccaacttccaggtttcgtaaacttgcttttgaatttcggctctggtttgagcaacagattcaaccatgttttggaccatggtatcttggaattcttgacctctaaaatctggcaaaacttcgtagaaatctctggcgaacttgtaatcatgttcagtagtttgcaaccaggacttggattggatttctttcaaccattcattatactttggatctggttctctaggttcggcaaatctaactggttgttgttgagtcaagaaacctggatgagcaccataattagcatcaaaagtaccttgaccatctctagcaattgggttaaaggtatgagcggatctattaactgggatttgttgatggttagcacccaatctatatctttgagcgtctgggtaagcgaaaattctagcttgtaaaattggatcttcagatggagcaacacctggaaccatgttagatggagagtaagccaattgttcaatttcggcgaagtagttagctgggtttcttttcaaagtcaacttaccgaaaacctttggtgggatcaaagtaacatcttttgggtaagtacccaagttccagtgcttagtaacatccaaaatgttgtaacccaagtttggagcatcttttggatcaacaacttgaacagaagcagtccaagttgggtattcacctctttcaatagcttcatacaagtctctagtagcgtgatctggatccaaatcatttgtacctttagcttgttgaccatcggtgaaatttggacctctatcagatgacaagaagatgtggacgtacttaaaagaaccatctggcttaacccatttgtaagcatgagccatataaccagacatggatctccaattgaacatagtaccgaaatcagaaaattgcaacaagaccatgtgcaaggattcatgattgttggtaacccaatcccagtacatgtttgggttcaacaaattagtttgtggatctcttctttgagcgtgcatcaaagatgggaacttgactggatcacgaatgaagaagaatgggaaattcaacatgacccaatcccaattaccttcagtagtgtagaacttacaagccatacctttcaaatctctcataccttcgttagaacctctttccaaaccagtggtagagaatctagtaacacatggagtctttttaccgacaccaaccaacatatcgatatcgcaaatatcggagatatcggcagtaacttcaaattcaccataagcaccagcacctttagcgtgaacaactctttctggaatcttttctctgttgaaatgggccaaggtatcaaccaaatgatgatcagacaaagccaaagttctaccatcagctggtggaccttcaggcttatgaaatggacaaccattagcagtagtgtaagttggcttagaatctggagccattttaagctttgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattatgcagatgttataatatctgtgcgtacgcgcccagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacggacacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaaagcttaaaatgggtcaatccagaggtattttgggtggtgttagacaattgatcttggttattttggttggtgcctacttgtctagattgtctgctgttgatgatgatagacatgattgcagatgtagaccaggtgaaccatgttggccaactgtttctcattggtctactttgaacgaatctattggtggtgctttggctcatgttaagccaattgctcatgtttgtcatcaatccggtcaagattcttctgcttgcgaacaagttttacaagaatccttggattctaagtggcgtgcttctcatactggtgctttacaagattgggtttgggaaggtggtgctgaatctaatcaaacttgttactacttgagatcaggtccagctggttcttgtcatcaaggtagaattccattatattccgctgctgttaagtccgcttctgatgttcaaaaggttgttgatttcaccagacaacacaacttgagattggttattagaaacaccggtcatgatggttctggtagatcatctggtccagattctgttgaaattcatacccatcacttgaactccgttcaataccatccaaattttagaccagctggttcctctgaaagacaatctgctccaggtcaaccagctgttactgttggtgctggtattttgttgggtgacttgtatgctagaggtgcttctgaaggttggatagttgttggtggtgaatgtccaacagttggtgctgctggtggttttttacaaggtggtggtgtttcttcttggttgtcttatgctcatggtttggctgttgataacgtcttggaatacgaagttgttactgctaagggtgaaatcgttattgctaacgctcatcaaaacccagatttgttttgggctttgagaggcggtggtggtggtacttttggtgttgttactcaagctacattgcaagttcatccagatttgccagtttctgttgctgatgctgttgttactggttctagagctgatgctactttttggtcacatggtgttgctgctttgttgagagctttacaattcttgaacaaccatggtactgccggtcaattcattttgagaaacactgatgatgataccgtccaagctagtttgactatgtacttctctaacttgactgttccagctgttgctgacgaaagaatggatcctttgagaagagctttggaacataatggtcatccataccaattgacctctagattcttgccacaaatctcttctactttcagacataccgctgatagatacccagaagattacggtattttgatgggttccgttttggtttccttggacttgtttaattctgctactggtccagctgctttggcacaacattttgctagattgccaatgactccagatgatttgttgttcacttctaacttgggtggtagagtctcttcattgaatagagatccagcttctactgctatgcatccaggttggagagatgctgctcaattattgaatttcgttagaggtgttggtgctccatctttggctgctaaagctactgctttacatgaattgcaaaccgttcaaatggccagattatacgaaattgaaccagccttccaaatctcctacagaaatttgggtgatccatccgaaagaagatccagagaagtttattggggttctaactacgctagattggttgaagttaagagaagatgggatccagaaggtttgttcttctccaaattgggtattgatggtgatgcttgggatgctgaaggtatgtgtagacaaacaagacaaggtgcttggaatgttgctgttaagtgggttcaatctttcttgggttctttgtctgcttccgttgtttgaccgcggcacgtccgacggcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgcaatggaaggtcgggatgagcatatacaagcactaagaagaacaatacagaactctacacggtattattgtgctacaagctcgagtaaaaccgagtgttttgacgatactaacgttgttaagaaagtaacttgttatcaaactcattaccaacttgtgattaattggtgaataatatgataattgtcgaaattccattgttggtaaagcctataatattatgtatacagattatactagaaattctctcgagaatataagaatccccaaaattgaatcggtatttctacatactaatattaccattacttctcctttcgttttatatgtttcattcctattacattatcgatctttgcatttcagcttccattatatttgatgtctgttttatgtccccacgttacaccgcatgtgacagtatactagtaacatgagtgctaccgaatagatgacattttagactttcattccaacaacttggttgacagaatgttacgtaccctatatctaatctatatgaggcctgaatctaactgaaaggtggaatttcagtaatttatcaagctttaataagtttgggtagtttaactgtgcaaaaaggtatttaccttacatactgaatcttgtctgtttggtagcggctgctttatcctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgat

SEQ ID NO: 116 - DNA, 7110 bp, Artificial Sequence
  pEVE2342 (YORW?22-BleR-P/A+Aj_EasD)
cggtgcgggcctcttcgctattacgccagctggcgaaagggggatgtgctgcaaggcgattaagttgggtaacgccagggttttcccagtcacgacgttgtaaaacgacggccagtgaattcgagctccctgcaggcaccggagcttggatatgataaacgaaatattcttgaatcgtgagatcgcctgttttcaaaaccgttggaggcagaaacaattttgtcacaagatgggcattctaccccatccttgctgtattattgtagtctcgctttcttttatgctggacaaatgagactactgcacatttttatacgttcttggttttttttaaaggtgtggtttcggcattatcctgccgcacgtttcttggataattcatcctgattctctattttaaacgcttcagcctatcaggatttggttttgatacatactgcaagagtgtatctcgggaacagtcatttattccgcaacaaacttaattgcggaacgcgttaggcgatttctagcatatatcaaataccgttcgcgatttcttctgggttcgtctcttttcttttaaatacttattaacgtactcaaacaactacacttcgttgtatctcagaatgagatccctcagtatgacaatacatcattctaaacgttcgtaaaacacatatgaaacaactttataacaaagcgaacaaaatgggcaacatgagatgaaactccgcgtcccttagctgaactacccaaacgtacgaatgcctgaacaattagtttagatccgagattccgcgcttccatcatttagtataatccatattttatataatatataggataagtaacagcccgcgaagcggccgccagctgaagcttcgtacgctgcaggtcgacaacccttaatataacttcgtataatgtatgctatacgaagttattaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtatgaccgaccaagcgacgcccaacctgccatcacgagatttcgatcccaccgccgccttctatgaaaggttgggcttcggaatcgttttccgggacgccggctggatgatcctccagcgcggggatctcatgctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggcgcgtgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcggttatggagttgcagcaccaacgttaatattggcaccgtaaactggtctagaatcttcagacaacaaccagacgatagttctagcaacatcttcaggttgaatgattgggaaaccttctttgatgtaggcttcttttacttcgtcgatagatttagcttgtggcatgaattgtggcaaagctggagtatcggtaatacctggagaaacagaattgattctaatacccaatggccaagcatccatagcagcacaagaagtaaagtaagcacaagcacctttagaagtaccgtaagcataagcatctggcaaatggataaaggcagcaatggaaccaatgttaacgatagctctatcttttggacctggcaaagccttcatagctctaataccagctctagtacagtagaaaacaccgtccaagttaaccttgaaaactctttgccattcttcatcagtttcttccaacaaagctggagcttgtctagcaccagctggttgagcaataccagcaacattagccaaaccatgcaagtcaccaaaagtttgaacgatagtttgcaaccaagcatcaacttcagcggatgaagaaacatccaatctagtgcaatgaacctttgtagctggattcaaggcttgaatatcagaggtaacggattcgaaaccctttggagaaatatcaccaatgcatataacagcagcacctctagcagccaataatctacaagtagcagcaccaataccagaagcaccaccagtaacagcgaaaattctagagttgacaacggtcattttaagctttgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattatgcagatgttataatatctgtgcgtggcgcgccggaccaactatcatccgctaattactgacattaccaaatgagatctgtgaatgggcaagataaaaaacaaaaattgaaatgtttgacgttatgtaaaactattaattccttcgctttcggcggtcacagaatttgcgtgtagctgactcttgttcaatcaatatcatttgttactttatttgaaagtctgtattactgcgcctattgtcatccgtaccaaagaacgtcaaaaagaaacaagataatttttgtgcttacaccatttatagatcactgagcccagaatatcgctggagctcagtgtaagtggcatgaacacaactctgactgatcgcacatattgccgttatcataaatactagttgtacttgtcaatgcgacgaatggcatcatgcctattattacgttcctctttttccgtttcatgtttccagaatgctattgaatctaacacttcaattataaaaaagaataaatccgcaataattttaggctaattgttgtactgtcaagcgaacctaatggttaaaattcagaggaaccttcgacgtagtctgatcgctacttctatatcttatgttcccagtcaatcaaaagttgatactataatagctgccatttatacctgttagttatggcgatcgtttatcacgcctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgat

SEQ ID NO: 117 - DNA, 8932 bp, Artificial Sequence
  pEVE2343 (YORW?22-BleR-G/C+Aj_EasH-P/A+Aj_EasD)
cggtgcgggcctcttcgctattacgccagctggcgaaagggggatgtgctgcaaggcgattaagttgggtaacgccagggttttcccagtcacgacgttgtaaaacgacggccagtgaattcgagctccctgcaggcaccggagcttggatatgataaacgaaatattcttgaatcgtgagatcgcctgttttcaaaaccgttggaggcagaaacaattttgtcacaagatgggcattctaccccatccttgctgtattattgtagtctcgctttcttttatgctggacaaatgagactactgcacatttttatacgttcttggttttttttaaaggtgtggtttcggcattatcctgccgcacgtttcttggataattcatcctgattctctattttaaacgcttcagcctatcaggatttggttttgatacatactgcaagagtgtatctcgggaacagtcatttattccgcaacaaacttaattgcggaacgcgttaggcgatttctagcatatatcaaataccgttcgcgatttcttctgggttcgtctcttttcttttaaatacttattaacgtactcaaacaactacacttcgttgtatctcagaatgagatccctcagtatgacaatacatcattctaaacgttcgtaaaacacatatgaaacaactttataacaaagcgaacaaaatgggcaacatgagatgaaactccgcgtcccttagctgaactacccaaacgtacgaatgcctgaacaattagtttagatccgagattccgcgcttccatcatttagtataatccatattttatataatatataggataagtaacagcccgcgaagcggccgccagctgaagcttcgtacgctgcaggtcgacaacccttaatataacttcgtataatgtatgctatacgaagttattaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtatgaccgaccaagcgacgcccaacctgccatcacgagatttcgatcccaccgccgccttctatgaaaggttgggcttcggaatcgttttccgggacgccggctggatgatcctccagcgcggggatctcatgctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggcgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaagggggacggatctccgaggcctcggacccgtcgggccgccgtcggacgtgccgcggttaggccttcttagcaacttgattagacttcaagtcaataccggtagccaaatccttcaaatcgtaggtccaaatatcaacacccttagcagaaacagttctccaaccaaccattttttgggccaatggagtcatagtttcaaccaattctcttggcaaagcaacactagcttcaactggagtgaattgacaagattgcatgatcaatgggaaacctcttctcaaaaaatcagtagtgttgttcttaccggcaccatgtaaagttttaccagtaaacaaaacagcatcacctggattcataacagctggaatagcagtatcagcttttggtggtggagcagaaaaatcttcccacaaatgagaacctggcaaaactctagtagcaccattttcagcagtgaaatcagtcaaagcagtcaagaagttcaacatagattctggagattgtctacccaaggtagtacagattggaataccatcatgttctctatgcaattcttgaccatggtaacctggttcagtttccaaaacagaagaagtagtcaaccagtaatcaccagattctggaccgaataatctcttgcacaaaccgtgcaataattcgtcgttcatcaattcatctctgaacaacttggagaacaaaggcaaagatgacaattgtctcataccagccaagtaagattcttggtaggatttttgacccaattcccattgcttcatgtgtggatcaatttcaccgttgaatcttctaacttggtcagcagacatgaaaccttcgataacaacaacgccatcttcttgcaagacttggaaaatagcttcatcaccagctgatcttggaattcttctcaaggttggcttagaagtttcggtaatggtcattttaagctttttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgtccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaacttggcgcgtacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaaagcttaaaatgaccgttgtcaactctagaattttcgctgttactggtggtgcttctggtattggtgctgctacttgtagattattggctgctagaggtgctgctgttatatgcattggtgatatttctccaaagggtttcgaatccgttacctctgatattcaagccttgaatccagctacaaaggttcattgcactagattggatgtttcttcatccgctgaagttgatgcttggttgcaaactatcgttcaaacttttggtgacttgcatggtttggctaatgttgctggtattgctcaaccagctggtgctagacaagctccagctttgttggaagaaactgatgaagaatggcaaagagttttcaaggttaacttggacggtgttttctactgtactagagctggtattagagctatgaaggctttgccaggtccaaaagatagagctatcgttaacattggttccattgctgcctttatccatttgccagatgcttatgcttacggtacttctaaaggtgcttgtgcttactttacttcttgtgctgctatggatgcttggccattgggtattagaatcaattctgtttctccaggtattaccgatactccagctttgccacaattcatgccacaagctaaatctatcgacgaagtaaaagaagcctacatcaaagaaggtttcccaatcattcaacctgaagatgttgctagaactatcgtctggttgttgtctgaagattctagaccagtttacggtgccaatattaacgttggtgctgcaactccataaccgcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcggcgcgccggaccaactatcatccgctaattactgacattaccaaatgagatctgtgaatgggcaagataaaaaacaaaaattgaaatgtttgacgttatgtaaaactattaattccttcgctttcggcggtcacagaatttgcgtgtagctgactcttgttcaatcaatatcatttgttactttatttgaaagtctgtattactgcgcctattgtcatccgtaccaaagaacgtcaaaaagaaacaagataatttttgtgcttacaccatttatagatcactgagcccagaatatcgctggagctcagtgtaagtggcatgaacacaactctgactgatcgcacatattgccgttatcataaatactagttgtacttgtcaatgcgacgaatggcatcatgcctattattacgttcctctttttccgtttcatgtttccagaatgctattgaatctaacacttcaattataaaaaagaataaatccgcaataattttaggctaattgttgtactgtcaagcgaacctaatggttaaaattcagaggaaccttcgacgtagtctgatcgctacttctatatcttatgttcccagtcaatcaaaagttgatactataatagctgccatttatacctgttagttatggcgatcgtttatcacgcctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgat

SEQ ID NO: 118 - DNA, 9280 bp, Artificial Sequence
  pEVE2344 (YPRC?3-NatR-G/C+Aj_EasA-P/A+Aj_EasG)
cggtgcgggcctcttcgctattacgccagctggcgaaagggggatgtgctgcaaggcgattaagttgggtaacgccagggttttcccagtcacgacgttgtaaaacgacggccagtgaattcgagctccctgcaggaaaggaggtgcacgcattatggagaccactacgatacgatagctgcgttgttgttgaaggggtttcttaaggttgttttcgttgaaggtaaatattggtcgtttttgtgcagcatattgtcctctagatgcaaactctgcaggtccatttgcagtaaagtgagttgcctctcgaagaatcattaatttcgtataaccgtcactattaaagtcagaaaataaattctgtcgtagacaatgttaccataatgttcttgtccattttgcatacactttaaatattcatttgatttctcagggttcatgatcataataaattgcgcattcgcaaggcggtagtattataatggggtccatcattctgtagcaagaagttacagtacgctgttcaagcgttaaacaagataagtaatctcgaatgaaacattcatatttcgcatgagccaacatacagttgctgagtaatcttcattgcgcttatttatcggcattgagattgtaaaggaagtaaaacgcatttttgcagatctgttctcttatgtatttttaatcgtccttgtatggaagtatcaaaggggacgttcttcacctccttggaagcggccgcctaataacttcgtatagcatacattatacgaagttaggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaacgaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaataacttcgtatagcatacattatacgaagttagcggccgcggcgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaagggggacggatctccgaggcctcggacccgtcgggccgccgtcggacgtgccgcggttaaccttgacaaatagaaccggtagcagcagcttctttcttcttcaatctttgaccgaattcagcaacatattcagcggagtatggatagtccaagtaaccttctttcaataaggaggtgtagaaagaagctctatcgtacttttgcaatggaatacctctttgcattctgaatggcaaatctggagtagaaataaagtatctaccgaaggcaacagcaacgttatcttcttctttgaaaaccttgtcagcaacttctggagcagaaacagcatcataaccaccagccaaaataactggtggggcttcttttttagcttcaataccatctctaccagaacctctccaagctctaacaaaaacttcatgatgtggatctggatgagaagtttcttcgtccaaccatctagaattagccaaatgcaagtaagccaaacctggaccgtcgttgtactcttctctcaatctcttaatcaagaattcgaattgtggaaccaaatcagccataacacccataccagcatattgtgaccatggagacaacttaactccaactctttcagcaccaacagcatcaacaacagctctagtaacagccaaagcaaatctagctctgttttcaatagaaccaccccagcaatcagttctttgattgcatggccattgagtgaattgatcaatcaagtaaccgttagcaccatgcaattcaacaccatcaaaaccaacttcatgaacagcaactctagcagcggtaacgaaatcagcaatgtaaccttcaatttcagcttgggtcaatggttgtggttgttgagattcagtttcaattggaacatcggaggaactgaccaatgggaaacctttttctttcaacaaagcaggatcagctgctctaccagtagcccacaattgacagaaaatgtagcaacctcttctatgaacagcagaaactatacctctccaagcagcaatttgagtagcagaatatagacctggaatatgtggttcaccagcagcttgtggagaaatatcggtagcttcagtaatcaacaaagtacctggaacagcagctctttgagcataatattcttgaacgaatggcaatggagtagcagtagaatcagctctgtatctggtagttggagccataatcaatctatgttgcaagtggcacaaaccaatcttcataggttgaaacaacttagaagctggagcacctggagaagatggatcgatggtcattttaagctttttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgtccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgggcgcgtacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaaagcttaaaatgaccatcttggttttgggtggtagaggtaaaactgcttctagattgtctgctttgttgcatgaagcgcaaatcccttttgttgtcggtacttcttctactgctccaattgctacttatagaaccgctcattttgactggttgaacaaggatacttggactaatgcttgggatcaagctccagaacctattactgctatctatttggttggtgctcatgctccagaatttgttcatccaatgttcgaattcatcgatttggctcattctagaggtgttagaagatacgctttggtttctgcttctaacactgaaaaaggtgatccaatgatgggtgaagctcatgctcatttggattctaaagaaggtgttaagtacgtcgtcttaagaccaacttggtttatggaaaaccacatcgaagatccacatttgtcttggattaagaccgaaaacaaaatctactctgctactggtccaggtaagattccatttgtttctgctgatgatattgccagagttgcttttcatgctttgactcaaccattgacccaaaaagaacaacaatatatggttttgggtccagacttgttgtcttatgctgatatggctgaaatcttgaccgatttgttgggtagaaagattacccatgttactttgccagctgaaaagttcggtcaattcttggttgatactgctggtttgccaccagattttgctgaaatgttggctactatggaagctgctgttgctactggtgctgaagaaagagtttctcaagacgttgaaaaggttactggtagaccacctagaagatttgttgattacgctagagaaaacagagaacattggttgtaaccgcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcggcgcgccgatgggacgtcagcactgtacttgtttttgcgactagattgtaaatcattctttatttaatctctttctttaactactgcttaaagtataatttggtccgtagtttaataactatactaagcgtaacaatgcatactgacattataagcctgaacattacgagtttaagttgtatgtaggcgttctgtaagaggttactgcgtaaattatcaacgaatgcattggtgtatttgcgaaagctacttcttttaacaagtatttacataagaataatggtgatctgctcaactgatttggtgataactctaacttttttagcaacaatttaaaagataattcgaacatatataacagtaggaagaatttgtgtacgtcaaattaagataatttagcattaccaaagttattaacctaaacataaaatatatatgagacacatgtggaaatcgtatgaaacaactgttatgaaactgacaagaatgaatatatagagtaagctccgcttgtaaagaggaatcacttaagtgtataaatgtctcgacgattactttagatccaagattgatgattgatattactctgtaatacttaagctcttttaatagctcactgttgtattacgggctcgagtaataccgcctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgat

SEQ ID NO: 119 - DNA, 2193 bp, Artificial Sequence
  EasE-of Aspergillus japonicus and codon optimized for S. cerrevisiae and fused with SUMO
atggattacaaggatgacgacgataagtccgactcagaagtcaatcaagaagctaagccagaggtcaagccagaagtcaagcctgagactcacatcaatttaaaggtgtccgatggatcttcagagatattcttcaagatcaaaaagaccactcctttaagaaggctgatggaagcattcgctaaaagacagggtaaggaaatggactccttaacgttcttgtacgacggtattgaaattcaagctgatcaggcccctgaagatttggacatggaggataacgatattattgaggctcacagggaacagattggaggtcagcttaaaatgggtcaatccagaggtattttgggtggtgttagacaattgatcttggttattttggttggtgcctacttgtctagattgtctgctgttgatgatgatagacatgattgcagatgtagaccaggtgaaccatgttggccaactgtttctcattggtctactttgaacgaatctattggtggtgctttggctcatgttaagccaattgctcatgtttgtcatcaatccggtcaagattcttctgcttgcgaacaagttttacaagaatccttggattctaagtggcgtgcttctcatactggtgctttacaagattgggtttgggaaggtggtgctgaatctaatcaaacttgttactacttgagatcaggtccagctggttcttgtcatcaaggtagaattccattatattccgctgctgttaagtccgcttctgatgttcaaaaggttgttgatttcaccagacaacacaacttgagattggttattagaaacaccggtcatgatggttctggtagatcatctggtccagattctgttgaaattcatacccatcacttgaactccgttcaataccatccaaattttagaccagctggttcctctgaaagacaatctgctccaggtcaaccagctgttactgttggtgctggtattttgttgggtgacttgtatgctagaggtgcttctgaaggttggatagttgttggtggtgaatgtccaacagttggtgctgctggtggttttttacaaggtggtggtgtttcttcttggttgtcttatgctcatggtttggctgttgataacgtcttggaatacgaagttgttactgctaagggtgaaatcgttattgctaacgctcatcaaaacccagatttgttttgggctttgagaggcggtggtggtggtacttttggtgttgttactcaagctacattgcaagttcatccagatttgccagtttctgttgctgatgctgttgttactggttctagagctgatgctactttttggtcacatggtgttgctgctttgttgagagctttacaattcttgaacaaccatggtactgccggtcaattcattttgagaaacactgatgatgataccgtccaagctagtttgactatgtacttctctaacttgactgttccagctgttgctgacgaaagaatggatcctttgagaagagctttggaacataatggtcatccataccaattgacctctagattcttgccacaaatctcttctactttcagacataccgctgatagatacccagaagattacggtattttgatgggttccgttttggtttccttggacttgtttaattctgctactggtccagctgctttggcacaacattttgctagattgccaatgactccagatgatttgttgttcacttctaacttgggtggtagagtctcttcattgaatagagatccagcttctactgctatgcatccaggttggagagatgctgctcaattattgaatttcgttagaggtgttggtgctccatctttggctgctaaagctactgctttacatgaattgcaaaccgttcaaatggccagattatacgaaattgaaccagccttccaaatctcctacagaaatttgggtgatccatccgaaagaagatccagagaagtttattggggttctaactacgctagattggttgaagttaagagaagatgggatccagaaggtttgttcttctccaaattgggtattgatggtgatgcttgggatgctgaaggtatgtgtagacaaacaagacaaggtgcttggaatgttgctgttaagtgggttcaatctttcttgggttctttgtctgcttccgttgtttga

SEQ ID NO: 120 - DNA, 1020 bp, Artificial Sequence
  EasF of  A. japonicus codon optimized for S. cerrevisiae
atgggttctattaacccaccaatcttggacattagacaatctactttcgaaacctccatcccacaacaagttactgaaggtttgactaaggatccaaaaactttgccagctttgttgttctattccggtgatggtattcaacattggaccagacattcttgtgctccagatttttatccaagaagagaagaaatcaacatcttgcattctgaagctgctcacatggctgcttctatttctcaagattccgttgttgttgatttgggttctgcttctttggataaggtcttgccatttttacatgctttggaagcccaacaaaaaagagttcattactacgccttggacttgtcttatccagttttggcttctaccttgtccgaaattccagttgctcaattccaatacgttcaaattgctgcattgcacggtactttcgaagatggtttacaatggttgcatgattccccagaagttagagaaagaccacatcatttgttgttgttcggtttgaccattggtaacttctctagaccaaatgctgctgctttcttgagaaacattgctgatagagctttggctgcttctccagctgaatcttctattttgttgaccttggattcttgcaagatgccaactaaggttttgagagcttatactgctgaaggtgttgttccatttgctttgacatctttgtcctacgccaatcaattattctggccaggtggtgaaggtagagtttttgatgaagaagaatggtacttccactccgaatggaattttgctttgggtagacatgaagctgctttgattccaagagatagagatattactttgggtccaccattggaacaagttgttgttagaagaggtgaaaaggttagattcggttgctcttacaaatactctgctgctgaaagagaacatttgtttgctggtgctggtttggaaaatgttgcttcttggtctgctaaaggttgtgatgttgctttctaccaattgaagatgagaccagaatga

SEQ ID NO: 121 - DNA, 1544 bp, Artificial Sequence
  CA cassette including both AscI sites
ggcgcgccatgcagggatatcagatctccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggccgcaggcctaaattgatctagagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttgttcttgagtaactctttcctgtaggtcaggttgctttctcaggtatagcatgaggtcgctcttattgaccacacctctaccggcatgcccatgggttaactgatcaatgcatcctgcatggcgcgcc

SEQ ID NO: 122 - DNA, 1290 bp, Artificial Sequence
  c-terminal truncated DmaW of A. japonicus codon optimized for S. cerrevisiae
atgactgctggtcaaggtattaagactggtaatgcttctgattgcgaagtctacagaactttgtctgttgctttggatttcgccaatcaagatgaagaattgtggtggcattctactgctccaatgtttgctcaaatgttgcaatctaccaactacaacttacacgctcagtacaagcacttgttgatctacaagaagaacgtcattccattcttgggtgtttacccaactaatgataagccaagatggttgtccattttgaccagatatggtactccattcgaattgtctttgaactgttctggtccattggttagatacacttacgaacctattaacgctgctactggtactgctagagatccattcaatactcatgctgtttgggactcattggaacaattgatggctttacaatccggtatcgatttggatttgttcagacacttcaagaacgacttgactttgtctgctgaagaatccgaatacttgtacaagaacaacttggtcggtgaacaaatcagaacccaaaacaaattggctttggacttgcaagatggtgaattcgttgttaagacttacatctacccagccttgaaatctttggctactggtagaagtatccacgaattggtttttggttctgctttcagatggtctaagcaatacccagaattgagaaagccattggataccttggaacaatacgtttattctagaggtccatcttctactgcctctccaagattattgtcttgcgatttgattgaccctaccaagtccagaatcaaaatctacttgttggaaagaatggtcactttggaagccttggaagatttgtggactatgggtggtgaaagaactgatgcttctactttggctggtttggaaatgattagagaattgtgggaattgatcagattgccagctggtttacaatcttatccagctccatatttgccaatcggtactattccagatgaacaattgccattgatggccaactacaccatccatcatgatgatccagttccagaaccacaagtttactttactactttcggtagaaacgacatgcaaattgctgatgctttggctactttcttcgaacgtcgtggttggcacgaaatggctagacagtacaaagctgaattgtgctctcattacccacatgctgatcacgaaactttgaactacttgcacgcttacatctcattctcttacagaaagaacaagccatacttgtccgtctacttgcaatctttggaaactggtgattgggttacctga

SEQ ID NO: 123 - DNA, 1347 bp, Artificial Sequence
  DmaW of C. purpurea codon optimized for S. cerrevisiae
atgagtactgctaaagatccaggaaatggcgtttatgaaattctgtctctcatttttgatttcccttctaatgaacaaagactgtggtggcattcaacagcacctatgttcgcagctatgttagacaacgcaggttacaatattcacgatcaatacagacatttggggatattcaaaaagcatatcataccttttctgggtgtttacccaactaaagacaaggaaagatggctttctatcttgactcgatgcggattgccattagaactatctttgaattgtacagattctgtggttagatacacgtacgagccaattaacgaagtcacaggtaccgaaaaagacacgtttaacaccttggccatcatgacttcagtccaaaaattggcacaaattcaagccggcattgacttagaatggtttagctactttaaagacgagttaacattagatgaatccgaatctgcaaccctgcaatctaatgaattggtaaaggaacaaatcaaaactcaaaataagttggcactagacttgaaggagtctcagttcgccctaaaggtatacttctatccacatctcaaaagtatagcgactggtaagtccacacatgatctaatctttgattctgtgcttaagttatcccaaaagcatgattccattcagcctgccttccaagtattgtgtgattacgtttcaaggagaaaccattctgcggaggtcgatcaacacggtgctctacacgctagattgttgtcatgcgatctcattgatccagcaaaatcaagagttaaaatctacctcttagagaaaacagtgtctttgtcagttatggaagatttgtggacacttggtggacaaagagtagacgctagtacaatggatggccttgatatgttaagggagttgtggtccctgttaaaggttccaacaggacatcttgaataccctaaaggctatcttgaattgggggaaataccaaacgaacagctaccatcaatggctaattacacccttcaccacaatgaccctatgccagagcctcaagtgtactttacagttttcggtatgaatgacgctgagatatcaaatgccctgactatctttttccagagacatggatttgacgatatggctaaaaactacagagtctttttacaagattcatacccttaccatgattttgaatccctcaactatctacacgcctatatcagcttcagctatagacgtaataagccatacttatctgtttacctgcatacttttgaaactggtcgttggccagtctttgctgattcaccaatctcttttgatgcttatagaagatgtgaacttagtacaaaataa

SEQ ID NO: 124 - DNA, 1509 bp, Artificial Sequence
  TE cassette including both AscI sites
ggcgcgccatgcagggatatcagatcttagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggagtgcttttaactaagaattattagtcttttctgcttattttttcatcatagtttagaacactttatattaacgaatagtttatgaatctatttaggtttaaaaattgatacagttttataagttactttttcaaagactcgtgctgtctattgcataatgcactggaaggggaaaaaaaaggtgcacacgcgtggctttttcttgaatttgcagtttgaaaaataactacatggatgataagaaaacatggagtacagtcactttgagaaccttcaatcagctggtaacgtcttcgttaattggatactcaaaaaagatggatagcatgaatcacaagatggaaggaaatgcatgcccatgggttaactgatcaatgcatcctgcatggcgcgcc

SEQ ID NO: 125 - DNA, 9453 bp, Artificial Sequence
  Fwd primer for Seq ID 126, w. homology to ERG20 prom and pEVE2049 upstream of loxP
ggctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaagatccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctgaattggagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttatttagaagtgtcaacaacgtatctaccaacgatttgacccttttccatcttttcgtaaatttctggcaaggtagacaagccgacaaccttgattggagacttgaccaaacctctggcgaagaattgttaattaagagctcgtttggctagtactgggtgatgacgccaggctctgatccatctggggttagtggtagttttgtctccctaacggtggttccggcggtcttggtcagcttggacagctcttggacggtggctgaaaggccagggtccacatggacagagttgaaggatgaggtaacccaatcaccagtttccaaagattgcaagtagacggacaagtatggcttgttctttctgtaagagaatgagatgtaagcgtgcaagtagttcaaagtttcgtgatcagcatgtgggtaatgagagcacaattcagctttgtactgtctagccatttcgtgccaaccacgacgttcgaagaaagtagccaaagcatcagcaatttgcatgtcgtttctaccgaaagtagtaaagtaaacttgtggttctggaactggatcatcatgatggatggtgtagttggccatcaatggcaattgttcatctggaatagtaccgattggcaaatatggagctggataagattgtaaaccagctggcaatctgatcaattcccacaattctctaatcatttccaaaccagccaaagtagaagcatcagttctttcaccacccatagtccacaaatcttccaaggcttccaaagtgaccattctttccaacaagtagattttgattctggacttggtagggtcaatcaaatcgcaagacaataatcttggagaggcagtagaagatggacctctagaataaacgtattgttccaaggtatccaatggctttctcaattctgggtattgcttagaccatctgaaagcagaaccaaaaaccaattcgtggatacttctaccagtagccaaagatttcaaggctgggtagatgtaagtcttaacaacgaattcaccatcttgcaagtccaaagccaatttgttttgggttctgatttgttcaccgaccaagttgttcttgtacaagtattcggattcttcagcagacaaagtcaagtcgttcttgaagtgtctgaacaaatccaaatcgataccggattgtaaagccatcaattgttccaatgagtcccaaacagcatgagtattgaatggatctctagcagtaccagtagcagcgttaataggttcgtaagtgtatctaaccaatggaccagaacagttcaaagacaattcgaatggagtaccatatctggtcaaaatggacaaccatcttggcttatcattagttgggtaaacacccaagaatggaatgacgttcttcttgtagatcaacaagtgcttgtactgagcgtgtaagttgtagttggtagattgcaacatttgagcaaacattggagcagtagaatgccaccacaattcttcatcttgattggcgaaatccaaagcaacagacaaagttctgtagacttcgcaatcagaagcattaccagtcttaataccttgaccagcagtcattttaagctttttgtaattaaaacttagattagattgctatgctttctttctaatgagcaagaagtaaaaaaagttgtaatagaacaagaaaaatgaaactgaaacttgagaaattgaagaccgtttattaacttaaatatcaatgggaggtcatcgaaagagaaaaaaatcaaaaaaaaaaattttcaagaaaaagaaacgtgataaaaatttttattgcctttttcgacgaagaaaaagaaacgaggcggtctcttttttcttttccaaacctttagtacgggtaattaacgacaccctagaggaagaaagaggggaaatttagtatgctgtgcttgggtgttttgaagtggtacggcgatgcgcggagtccgagaaaatctggaagagtaaaaaaggagtagaaacattttgaagctaagatctacgcacagatattataacatctgcataataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaaagcttaaaatgacaatttctgctccacctattattgatattagacaagcagggttggaaagttctataccagaccaagttgtcgaaggtctaactaaggaagtcaagacacttcctgcacttttgttttactcaacaaaaggcattcagcattggaatagacattcccacgctgctgatttctatcctagacatgaggaactatgcatcctcaaagctgaagctagtaagatggctgcttcaatcgctcaagatagcttagtaatcgatatgggttctgccagtatggataaggttatcctcctgttggaagcgttagaggaacagaaaaagtccataacttactacgccttggacctgtcctactctgaattagcatctaattttcaagccattccagtggacagattccactatgttagattcgcagccttacatggcacttttgacgatggacttcactggttacaaaacgctcctgatattaggaacagaccaagatgtatactgttatttgggttaaccatcggtaacttctcacgagataatgctgcatctttcctcagaaatatcgcccaatctgctctgtctacatccccaactcaatcatccattatagtgtctctagattcatgtaaacttcctacgaaaatcttaagagcctacaccgcagatggagtagttccatttgctcttgcctcactaagctatgcgaattcattgtttcatccaaaaggcgacagaaagattttcaatgaagaggattggtactttcattctgaatggaaccatgcattgggtcgtcacgaagctagtttgatcacacaatcaaaagatatccaattaggtgcaccactagagactgttatagtcagacgtgatgaaaagatcagatttggatgctcttacaaatacgacaaagctgaaagggatcagttgtttcattcagcgggtttggaggatgccgcagtgtggacagcaccagactgtgacgtagcattctatcaattgagactaagattgaactaaccgc

SEQ ID NO: 126 - DNA, 4762 bp, Artificial Sequence
  pEVE2049_LoxP-NatR-LoxP-Kex2 promoter
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccctgcaggatcgtcaaggttcgtattgttggtttagccggtgtgcattttaagaaaatttctgggaacacttggttgtataaagagctggcttctagtatattaaaagaactaaagttgtaagtaacacgttccctgagaaaccacagcttacatttttgatattcgaaaacaagaatatccgttcgatagaaatttatatatatatatagattctttttattctcttttggaaagaagaaatagaatggacctaagcagacactcagcagttaatattttcgtcccttaattggtattatttataaataaatggcacgtactttatgtgtaaagcagttcatcatcgattgatggaggcggccgcctaataacttcgtatagcatacattatacgaagttaggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaacgaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgccggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaataacttcgtatagcatacattatacgaagttagcggccgccctaggccgcggtcagcagctctgatgtagatacacgtatctcgacatgttttatttttactatacatacataaaagaaataaaaaatgataacgtgtatattattattcatataatcaatgagggtcattttctgaaacgcaaaaaacggtaaatggaaaaaaaataaagatagaaaaagaaaacaaacaaaggaaaggttagcatattaaataactgagctgatacttcaacagcatcgctgaagagaacagtattgaaaccgaaacattttctaaaggcaaacaaggtactccatatttgctggacgtgttctttctctcgtttcatatgcataattctgtcataagcctgttctttttcctggcttaaacatcccgttttgtaaaagagaaatctattccacatatttcattcattcggctaccatactaaggataaactaatcccgttgttttttggcctcgtcacataattataaactactaacccattatcagaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 127 - DNA, 68 bp, Artificial Sequence
  Fwd primer for Seq ID 126, w. homology to ERG20 prom and pEVE2049 upstream of loxP
cattattcttaaatgttccgatcctcttgttcgcatatatacagtcgattgatggaggcggccgccta

SEQ ID NO: 128 - DNA, 73 bp, Artificial Sequence
  Rev primer for Seq ID 126, w homology for Kex2 promoter and 5-end of ERG20 ORF
ctactaacccattatcagaagacaatggcttcagaaaaagaaattaggagagagagattcttgaacgttttcc

SEQ ID NO: 129 - DNA, 1326 bp, Paecilomyces divaricatus
atgagttccagaaagactcgaaatgcgtctagttcagaagtctaccagactctcagcagtctcttcgacttccctgacgaggagcagaagctctggtggcacagtactgcgcccatgtttgccgacatgctccagacggccaactacgacacccatgcccagtatcgacatctggggatttacaagaaatacgtgatcccgttcctaggtgtctaccccactaatgaccgtgatcgatggctgagcattctgacgcgctacggtacaccgtttgagttgagtctcaactgttcggatgacgttgtgcggtacacattcgagcccatcaacgctgcgacgggcaccatccaggaccccttcaacactcacgccatctgggactgtctgcagaacttcagcccaatgctgaaaggggtggacctcgaatggtttagctatttcaaagagaaactcaccctcaatgcggacgaatctgccttccttgtggagaataacttggctgatgatccgatcaagacccagaacaagctggccctggatcttaagaacagcggctttgtgctgaagacgtacatctatccggccctcaagtccatcgccacgggccttgcggctcccttgtcggtgatagatgagtatgtccactcccgggggcctaatggcacggccggccctcgcctcttctcctgtgacttggttcatccgagcaagtctcgcatcaagatctatattctggagcggatggtctcgttagccgccatggaggatctctggacgctaggtggccgacgcaaggatcactcgactctggcaggattgaatatgatccgtgagctctgggagctgatccaactgcctgccgggctgcgttcctacccggagccatacctgcctctgggtaccattccgaatgagcagctgccgttgatggccaattacacgcttcaccaggacgatccctggcccgagccccaagtgtacttcaccccatttggcatgaacgacatggcgattgccgatgcattgacgacgttcatggagcgccgggggtggaacgacatggctcagtcgtacaaggacaatttgtgctcatattatcccaacgcagaccacgatcatctgaactacgtgcacgcatatatatccttctcgtaccggaatgacaagccgtatttgagcgtgtacctacactccttcgagacgggggattggaagatctcgaacttcaccaatcccgaatcgaagtgcaaagaaccacagcgtgtgtctgtccgatttcctgtacaaggaagaggaagaggtcggatccctgcaagtggatattga

SEQ ID NO: 130 - DNA, 1140 bp, Paecilomyces divaricatus
atgacacaagcttcacctgcatctaagctcttcacgccgttaagcgtcggttcatgcaaactataccacagactcgtcatggcgccgatgactcgatttcgagcagatgagtctgccatccagctaccttttgtcaaagaatactatggacagcgggcatctgtccccggaacattgctgataagcgaggcaaccgacatatctccccaagctgggggattcgcgaatgtcccgggtatctggaatgaagcgcagattcaagcatggaggcagattgtaggcgaggtgcattccaagggctcctttatcttttgccagctgtgggcgacgggtcgcgctgctgaacccagtgtgctcgccgagaagggattcacgctagtttccagcagtgcgaccccaatatcgcccgacggactgttaccatgtgcactgactgaggtcgaaatccacgattatatcgatgacttcgcacaagcagcgcagaacgcaatactcgccggatttgatggtgttgagattcacggcgcaaacggctatcttattgaccagttcacgcaagcttcatgcaacaagcggattgatcactggggtggaagtattgcgaaccgtgcccgattcgcgatcgaagtgactagggccgtcgttgctgccgttggtgcagatcgagtgggtgtgaagctatctccatggagtcagtaccagggcatggggaatatggacggtctagtggcgcaatttgagtatctcatctcccaactgcagaagatggatcttgcatacctgcatctggctaattcaacatggctgggagaggagggtcctcattcagaccctcaccatgaagtgtttgtgcaggcgtggggaaagtccaaacccatcttgttggcaggagggtatgatgccgcgtcggcaaaacaggttgtggatatgctttatggcgaacacgacaatgttgcaatcgcgttcgggcggtttttcatttcgaaccctgatcttccctttcgggtaaagtcgaatgtcaagcttcaagactatagtcgttcttcgatggataccagcgtgtcgaaagacggatatttggatcatccattcagtccggagtttctggcttccaacagatctgaatttgccagtacttag

SEQ ID NO: 131 - DNA, 1560 bp, Paecilomyces divaricatus
atgagaacaaaggacgacaacgctcccaagccggaccccgatggggtgcccgcgtacacgacttcaaatggctgtcccgtcatgaggcccgagggactgccagcagacggcaggaagctcctcctaaacgactcccacctcattgacatgttagcccacttcaacagagagaaaatacctgagcgtgcagtccatgccaaaggcgccggagcatacggagagttcgaggtcaccgaggatatctctgacatttgcaacatcgacatgttgctaggagtcggcaagaagactccctgtgtcacgcgcttttccaccaccgggctggagcgcgggtcgtctgatggcgtccgagacctcaagggtctggcaacgaagttctacaccaagcagggcaactgggattgggtctgcctcaactttcccttcttcttcatccgggatccgatgaagttccccagcttgatgcacgcccagcgccgggatccccagaccaacctgctgaacccaaatatgtactgggattgggtgacgagcaaccatgaatctctgcacatggtgctgctgcaattcagtgacttcggcaccatgttcaactggcgctcaatgagcggatacataggtcacgcatacaaatgggtcatgccagacggctcctacaaatatgtgcacatcttcctttcgtcaaaccagggccccaatttcacggacggcggccccgacaaaaaagacaatgggctggaaccagaccatgccaccagggacctttacgaagcgatcgagagcggtgattacccgagctggacggccaatgtgcaagtagtcgacccgaaagatgctccgaagctgggatttaacattctcgatatcaccaagcactggaatctcggcacatacccgaaggatctggaagccattccgtccagaccgttcggaaagctgactctgaaccgcaacccacaaaactatttcgctgaaatcgagcagctcgcattttccccgtctaatatggtccccggtgtcgagccatcggaggatccaatcctccaggcgcgcatgtttgcctatccggatgctcagcgctaccgcctgggcgtgaacaaccaacatctgcccgtcaatcgaccccagcacgtcttcaatccccttctgcgagacggtgctggaatggcctctggcaactacggctccctgcccggctacgtgtccgactatcacccaatgaagtttcagaaaccaacaccccagaacccggagttcgactcgtggctggctcagatctcctcgcagtcatggggccaatcaaatgagcaggactacaagttcgccagggaatactacttggcactgccggagttccgaagccaggagttccaggacactatggtccgaaatatttgtcaatctgtggcacagacgaatcgcgagatacgcgagaagacataccgcacgttcgacctggtccaccgggggctggcggatcgtatccggcagggggtggaggagctggttgcggaggcgttcgtcatcccacgaggatcatcttcgtcactgagattatag

SEQ ID NO: 132 - DNA, 786 bp, Paecilomyces divaricatus
atggcgtctgtatcatctaggatctttgccatcactggcggcgcatcaggcatcggtgccgcaacttgtcgcctactcgcccaacgcggcgcagccgtcatctgcgttggcgacatctcacatgggaactttgacgatctgaaaaaatcgattaaagagatcaacccatcaacagaggttcactgcacgtctctggatgtgacctcagttgctgaggtagacaaatggatacagagtatcatctcaagctttggggacttacatggagctgcaaatgttgctggcatcgcccagggtgcaggcatgcgaaagtccccaaccattgtggaggagacagacgaagaatggaataagattttcaaagtcaatctagacggtgttttctactgcactcgggctgaggtgcgggctatgaaggaccttccccgaggaagtcgcagcattgtcaatgttggcagcattgctgctctctcccatatgccggatgtctatgcgtacgggacgtcgaaaggggctgcggcctacttcactacgtgtgcggcggcggattcgtttccactagggattcggattaatggtgtttctccaggaatcacggacacccagctactaccgcagttcatgccgggcgcaaaatcggccgatgaagtgaaagaagcatacgagaaggagggtttcacaatcatcaagccggatgatgtcgcacggacgatcgtatggttgctgagtgaagattcaactcccgtgtatggggccaacatcaacgtcggtgctggcgtgccctag

SEQ ID NO: 133 - DNA, 1830 bp, Paecilomyces divaricatus
atgcgatacgttctcctcgccgtggcaggtcttctcttgggctggctctcctttacggggaaggattcccggccatgtcgttgtagaccgtggacatcatgctggccctcggaagagacgtggagggccttcaacaaatccatagatggcaatctaatccgtctcaggcccatagcccatgtgtgccatgagcccacgttcaaccagagcgcctgtaacgaactgcgtcgtttttcactggacagcggatggagggctgcacaaccaggggcattgcaggactgggtctgggagagtggctccaaccctgacgaggcctgtcttatggcatcaccgcgcgagatgccctgtcaccaaggccgagtccctctcttttcggctgctgttgactctgctgagcaggtccagcgggcggttcgattcgctaaacggtacaacctccgtctcgtcattcgcaatacgggccatgacggtgcgggacagtccagtggtcccgattcgttccagatccatacccatcgcctgcaggcaattcagtaccacacggactttcagccaaatgggtctctcgtacgtctgggctctgccgtgactgtgggagccggggtgcagctcggggacctgtacgcacgaggctcgctcgagggatatactgtggtcgggggtgaatgtccaaccgtgggtgccgctggcggtttccttcagggcggaggtgtatctagtttcctgagtcacagctgggggctggctgtggataatgttctcgaattcgagatggtgaccgcccagggagacctggtcgtcgccaacgcacaccaaaaccaagaccttttctgggcgttgagaggaggcggaggcggcacctttggtgtcgtgactcgagccactcttcgagcgtatcatgatctccccgttgtagtggcgaagctcaccatcgcagccctcgacgcggatgcaatcttctggaccaaaggcgtcaccactcttctcacagcactgcagaaattcaaccgtgaaagtgttgccggccaattcctcttaaaaccccagacggagagcggaattgaagccagcattacgatgtatttcatcaacgagactgagacggcgcgtgttgacgaccgcctaaatccgctgctgaccatccttaacagcgacggcatcacatctgctcggtcatcgcaattcctgccccggctcagcatggatctccgaacagcacccgacatctatcctgagaactacgggattctaatggcgtctgtcctcgtttcgaaccagctgttcaattggtccgagggacctcaacgaatggcggagaactttgcacgactacctatgggaccccatgatctgctcttcaccagcaaccttggcggccgtgtcatagccaacggagacgtcgtggacacggcgatgcatcctgcctggcgctctgccgcccagctcatcaacttggttcgggccgttgatccgtccatatcaggcaagtccacggctttagaaggccttacgaacatccaaatgccaatcctatattctctcgatccggcgtttagggcctcttatctgaatctggcggatcccaatgagaaagactctccccaggtcttctggggagagaactatggacgtctgttacagatcaagcggaagtgggatgcaggtgatctcttcctcacgaagctgggagtgggtagcgatgactgggagatggacgggatgtgtagaaagcggcagaatctgataaatcgtgcgtttaagtctgttccaagccaagttggcaagaccctgtggcgcttgctggagggcagttcgaatgatttgtaa

SEQ ID NO: 134 - DNA, 1026 bp, Paecilomyces divaricatus
atgccgacctctcgaatcatcgatatccgccgttccaaattcgaaggttcgattccggaccaggtcgtcgacgggctcacgagcagccccaagaccctcccggctctcctcttctacagtacagagggaatccagcactggaatcgccactcccactctccggatttctacccgagacttgaggagatccggattctgaagaaacaggcctctgtgatagccacatccattgccgataacagcgttgtcgttgatctgggcagcgccaccctggacaaagtgaccttcctcctggaagcacttgaagcccagcagaaaaacatagactactatgcattggacttgagcccctcggagctggctgcaacgctcgaggccgtgccaatccatcaattccaccacgtcaggttcgctggcctccatggcacctttgacgacggcttgcaatggctgaaggagacaccggagatctgcgaccggccgcattgcgttctcctgttagggctgacgattggcaacttctctcgccaaaacgccgcctctttccttcgtggcatcgcccaccacgccctctcaaccagcccggcacagagctccattctggtcaccatggacagttgcaaagagccgaccaaggttctacgcgcgtacacagctgacggcgtggttccgttcgcgttgtcggctctgaaatatgcgaattccctgctcagaccagaagatgcagagatagaagggggtgaggttttcaaggtggatgactggtatttcctcagcgagtggaactacgtacttgggagacacgaggcatccttgattccacagtcgaaagatattaaactgggggcacctctggagaggatagtcgtgagaagagaggaaaagattcgctttgggtgtagctacaaatataaccgagcagaaagagaagagctcttccgatctgctggtgtaattgaagatgcactttggtcggatgaaggctgtgatgtggcattctaccagttgaaaatgattccgaattga

SEQ ID NO: 135 - DNA, 873 bp, Paecilomyces divaricatus
atgactatccttgtgctcggtggccgcggcaagactgcccagcgtctcgcctcgcttctcgatgcggccaacattcccttcctgctggggtcgagctcaaccgctcatgtcagcccattcaggctatcgtacttcaactggttcgaagaagaaacctatggaaacccatttgttcaagcatccacggaaggcttggatgctgtctcaaccgtgtatctagttggacccccggtcatggacatggttccgccaatgctcaaattcattgacctcgcgcggtccaggggtgttgaaaagttcgtgcttctcagcgccagtacagttgagaaaggaggccactcaatgggagaggtccatggatacctagattctctgaaaggagtcaagtatgtcgcgttaagaccgacttggtttatggagaacctcctggaagaaccccatctttcgtggatcaaacgacagaatacgatatattccgcgacgggggacggcaagattccgtttatatcggcagacgatattgctcgggtagcatttcgggccttgacggactcgaacacccaagctacagaatatctcatattagggccagaattactatcctatggtcaggtggcggacatcctcacctccgtccttggcaggaaaatcactcatgtcagtctctccgagccagattttactcggctcctagtggatgaggttggattgcctcctgattttgcagccatgctggccgggatggaagtagatgtcaagaacggcggcgagaacagactcagtaacagcgtcaagcaggtgacgggtatatcacctcagaccttccatgattttgcagtgaaagagaagcagcactggacatatgatggctaa

SEQ ID NO: 136 - DNA, 870 bp, Paecilomyces divaricatus
atgactgttaccaagacctccaaaccagtgctgcgccgcctccccatcagtgctggcgccgatgccatcttccaagtcctccaagaggacggcgtgttgatcatcgaggggttcctcacaccagaacaggtgaaaaagttcaacgcggaagtcgaccctcatctcaagaaatgggagctcggccaaggttcgatgcaggaaggctatctagccaacatgaagcaactgagcagtctcccactgtttagcaaaaccttccgggacgatcttatgaatcatgacctcttgcacggcatctgcaagaaggcctttggtcctgactccggagactactggttgaccacgtcgtcggtcttggagacagatcctggctaccccggtcaagatctgcaccgcgagcacgatgggattccaatctgcaccaccctggggcgagacagtcctgaagcgatgctgaacttcctaacggctctcacggacttcacggaggagaatggggctacccgcgttctcccaggcagtcatctctgggaggactacagcaaatctgtctctcccgatcaggcgataccggcagagatgaaccctggcgatgccgtgctgtttagtgggaagactctgcatggcgctgggaaaaatcagagtaaggattttctccgccgtggtttccccctcatcatgcaatcgtgccagttcacgccggttgaggcatccgtcgccattccaagatcccttgtggagacgatgacacctcttgcgcagaagatggtcggctggcgatcggtatctgccaagggtgtcgagatctggacctatgacttgaaggatcttgcaaagggattgaaattgaaagctatagctgctgagtga

SEQ ID NO: 137 - DNA, 1605 bp, Aspergillus japonicus
atgactgctgggcaaggcatcaagacgggcaatgcctctgactgtgaagtttaccgcacgctgagcgtcgccctcgactttgccaaccaggatgaggagctctggtggcacagcaccgcgcccatgtttgctcagatgctgcagtccaccaactacaacctccatgctcagtacaagcacctgctcatctacaagaaaaacgtcatccctttcctcggggtttatcccacaaatgacaagccccggtggctaagcatcctgacccgatacggcaccccctttgagctgagcctgaactgctccggcccactggtgcgctacacctacgagcccatcaacgcggccacggggacggcgcgcgacccgttcaacacccacgctgtctgggacagtctggaacagctgatggcgctgcagagcgggattgacctggacctcttccgccacttcaagaacgacctcaccctcagcgctgaggaatctgagtacctgtacaagaacaacctggtgggcgagcagatccggactcagaacaaactggcgctggatctccaggacggcgagttcgtggtcaagacctacatctacccggccctgaagtcgctcgccacgggcaggtccatccacgagctggtcttcgggtctgccttccgctggtccaagcagtacccggagctccgcaagcccctggacacactggagcagtacgtctactcgcggggccccagcagcacggccagcccgcgtctcctctcctgcgacctgatcgaccccaccaagtcccgcatcaagatctacctgctggagcggatggtcaccctggaggccctggaggacctctggaccatggggggcgagcgcaccgacgcctcgaccctggcggggctcgagatgatccgcgagctgtgggagctgatccgcctgcccgcgggcttgcagtcgtatccggccccgtatctgcccatcgggaccatcccggacgagcagctgcccctgatggccaactacaccatccaccacgacgaccccgttccggagccgcaggtctacttcaccaccttcggccgcaacgacatgcagatcgccgacgcgctggccaccttcttcgagcgccgcggctggcacgagatggcgcgccagtacaaggccgagctgtgcagccactacccgcacgccgaccacgagaccctgaactacctgcacgcctacatctccttctcctaccgcaagaacaaaccctacctcagcgtgtatctgcagtcgctggagacgggcgactgggtcacttgtaagctctccccttccgtgttcctttcctgcacacttccccaccgtggatacatccctgatgatctgacctgttcgcgcagcatccttcaactctgtccatgtggaccccggcctctcagccaccgtccaagagctgtccaagctgaccaagaccgccgggaccaccgttcgcgagacgaaactcccactcaccccggatggatcggagcccggcgtcatcacccagtactaggaaatcatctcgttggaccggatttgccagcttcccgccggggagttgcaagtgctttgtatgtaggtaggggaactagatga

SEQ ID NO: 138 - DNA, 1239 bp, Aspergillus japonicus
atgacgatcgacccctcctcccccggggcgcccgcctcgaagctcttccaacccatgaagataggcctatgtcacctccagcaccgcctcatcatggcccccaccacccgctaccgcgccgacagcaccgcgacgcccctccccttcgtgcaagaatactacgcccaacgcgccgccgttccggggacactcctgatcaccgaagccaccgacatctccccgcaggcggccggagaaccgcacatcccaggcctgtacagcgcaacccagatcgccgcgtggcgggggatcgtctccgccgtgcaccgccggggctgctacatcttctgccagctgtgggcgaccggacgggcggcggaccccgccctgttgaaggagaaggggttccctctcgtctcgagcagcgatgtgcccatcgagactgaatcgcagcagccgcagccgctgacgcaggccgagatcgaggggtacatcgcggacttcgtgacggcggcaagggtagcggtccacgaggtggggttcgatggggtggagctgcacggcgccaacggatacctcatcgatcagttcacgcagtggccgtgcaaccagcggacggattgctggggcgggagcatcgagaaccgcgcgcggtttgcgctggcggtcactcgcgcggtggtggatgccgtcggggcggagcgcgtcggggttaagctgtcgccctggagtcagtacgccgggatgggggtgatggctgatttggtgccgcagtttgagttcttgatcaaaaggttacgggaggagtacaatgatggtcctgggctggcgtacttgcatctggcgaattcaaggtggttggatgaggagacttcccatccggatccgcatcatgaggtcttcgtgcgcgcgtggagggggtcgggcagggatggtattgaggcgaagaaagaggcgcctccggtgatcctggccggcggctatgatgctgtctcggcgcccgaggtcgctgataaggtgttcaaggaagaggacaatgtcgccgtcgcgtttgggcgatattttatctcgacgcccgacctgccgttccgcatgcaacggggcattccattgcagaagtatgatcgcgcctcgttctatacctcgcttttgaaagaaggttatctggattatccgtacagtgcggagtatgttgcggagtttgggcagaggctgaagaagaaggaggcggcggcgacagggtcgatatgtcagggttga

SEQ ID NO: 139 - DNA, 1530 bp, Aspergillus japonicus
atggcgcccgatagcaagccgacctacaccacggcaaatggctgtcccttccacaagcctgagggtcctccggcggatggaaggacgctggcactcagcgaccaccatctggtcgataccctcgcccacttcaaccgggagaagatccccgagcgagtggtgcatgctaaaggagcgggagcctatggcgaatttgaggtgacggccgacatctcggatatctgcgatatcgacatgctggtgggagtgggcaagaagaccccctgtgtgacgcggttctcgacgactggcctcgaacgcgggtccaacgagggaatgcgcgacctgaaaggcatggcctgcaagttctacaccaccgagggcaactgggactgggtgatgctcaacttccccttcttcttcatccgcgaccccgtcaagttccccagcctgatgcacgcccagcgccgggatccgcagaccaacctgctgaaccccaacatgtactgggactgggtgaccaacaaccacgagtcgctgcacatggtcctgctgcagttcagcgacttcgggaccatgttcaactggcggtccatgagcggctacatggcccacgcgtacaaatgggtgaagcccgacgggtcgttcaaatacgtccacatcttcctctcctccgatcgcgggcccaacttcaccgacggccagcaggccaagggcacgaacgacctggatccggaccacgccacccgcgacctgtacgaggccatcgagcgcggcgagtatccgacgtggacggcgagcgtgcaggtggtcgaccccaaggacgcgccgaacctggggtacaacatcctggacgtgaccaagcactggaacctgggcacgtaccccaaggacgtgacgctgatcccgcccaaggtcttcggcaagctgacgctcaagcgcaacccggccaactacttcgccgagatcgagcagctggcctactccccctcgaacatggtgcccggggtggccccctcggaggacccgatcctccaggcgcgcatcttcgcctacccggacgcccagcggtaccggctgggcgccaaccaccagcagatccccgtcaaccggtccgcccacaccttcaaccccatcgcgcgcgacggccagggcaccttcgacgccaactacggcgcccacccgggctttctgacccagcagcagcccgtccgcttcgccgagccccgcgagcccgaccccaagtacaacgagtggctcaaggagatccagtccaagtcctggctccagaccaccgagcacgactacaagttcgcccgcgacttctacgaggtcctgccggacttccgcgggcaggagttccaggacaccatggtccagaatatggtcgagtccgtcgcgcagacgcgcgcggagatccaaaagcaggtctacgagacctggaagctggtgagtccagcgctggcggcgcgaatccagaaaggggtggagacgctgctgcagaagagtgaggcgccggcggaggagtctttcatcccggcaagattgtag

SEQ ID NO: 140 - DNA, 789 bp, Aspergillus japonicus
atgaccgtcgtcaactcgcgcatctttgcagtcaccggcggcgcctccggcattggcgcggccacctgccgcctcctcgccgcgcgcggcgcagcggtcatctgcatcggggacatctcgcccaagggcttcgagagcgtcaccagcgacatccaggccctcaacccggccaccaaggtgcactgcacccggctggacgtctcctcgtccgccgaggttgacgcctggctacagaccatcgtgcagaccttcggggacttgcacgggctggccaacgtcgcgggcatcgcccagccggcgggcgcccgccaggccccggccctgctcgaggagacggacgaggaatggcagcgcgtgttcaaggtcaacctggacggggtcttctactgcacgcgcgcaggtatccgcgcgatgaaggcccttccggggcccaaggaccgcgccatcgtcaacatcggtagcatcgccgcgtttattcacttgccggatgcctacgcctacgggacctccaagggcgcctgcgcgtacttcaccagctgtgcggccatggatgcctggcccctggggattcggatcaacagtgtctcgccgggtatcaccgacaccccggctctgccgcagttcatgccccaggcgaagtccatcgatgaggtcaaggaagcgtacatcaaggaggggttccctatcattcagcctgaggatgtggccaggacgattgtctggctgctcagcgaggattcccgcccggtgtatggggccaatatcaatgttggggctgctactccttga

SEQ ID NO: 141 - DNA, 1866 bp, Aspergillus japonicus
atgggtcagtcacgagggatcttgggaggcgtgaggcaacttatcctggttattctggttggggcatacctcagccggctttcagcggtggatgacgaccgccacgactgtcgatgtcggccgggggagccatgctggcccacggtcagccactggagtactctgaacgagtccatcggcggtgctctggctcatgtcaaacccatcgctcacgtctgtcaccagtctggtcaggactcgtcggcttgcgagcaggtcttgcaagagagtcttgacagcaagtggcgggcgtcgcacacgggcgcattgcaagactgggtctgggaaggtggcgcggaatccaaccagacatgttactacctgcggtccggtccggctggatcatgccaccagggccggattcccctctactccgcggctgtcaagtcggccagcgacgtgcagaaggtcgtggacttcactcgtcaacacaatttacgattagtgatccgcaacaccggccacgatgggagcggccgatccagtggaccggactctgtcgagatccacacccaccatctgaacagcgtgcaatatcaccccaacttccgccccgctggatcttctgagcgccagtcggctccaggacagccagcggtgacagtaggcgccggaatcctgcttggggacctctacgcccgcggcgcctcggagggatggatcgtagtgggcggggagtgtcccaccgtcggggcggccggcggattcctccagggcggaggagtatcgagttggctgagctacgcgcatggattggcagtggataatgtgcttgagtatgaagttgtgacggccaagggagagattgtcatcgccaacgcccatcaaaaccccgatctcttctgggcactgcgcgggggaggaggaggcacctttggcgtcgtgacccaggccacgcttcaagtccaccccgacctccccgtcagcgtcgccgacgccgtggtgacgggctcccgcgccgacgcgaccttctggtcccacggcgtcgccgccctcctgcgagcgctacaattcctcaacaaccacggcacggcaggccagttcatcctccgcaacaccgacgacgacacggtgcaagccagtctgacgatgtacttctcgaacctgaccgtccccgccgtcgccgacgagcgcatggacccgctccgccgcgccctcgaacacaacggacacccctaccagctcacctcgcggttcctgccccagatcagcagcaccttccggcacaccgcggatcgctacccggaggactacggaatcctgatgggctcggtcctggtgtcgctggacctgttcaattccgcgacgggccccgcggcgctggcgcagcacttcgcgcggctcccgatgacccccgacgatctcctgttcaccagcaacctgggcgggcgagtgtcctccctcaaccgcgacccggccagcacagccatgcatcccggctggcgtgacgccgcgcagttgctcaacttcgtccgcggggtcggggccccttctctcgcggctaaggccaccgccctccacgagctgcagacggtccagatggcgaggctgtatgagattgaaccggccttccagatctcgtaccgcaacctgggagatccctcggagcgccgcagtcgggaggtctattgggggtcgaactacgcgcggttagtggaggtcaagcggaggtgggatccggagggactgttcttcagcaagctggggattgatggtgatgcatgggacgcggaaggaatgtgtcgtcagacgcgccaaggggcgtggaatgtggcggtcaaatgggtccagagcttccttgggtctttgtctgcttctgtggtgtag

SEQ ID NO: 142 - DNA, 1020 bp, Aspergillus japonicus
atgggcagcatcaatcccccgattttggacatccgccagtcgaccttcgagacctccatcccccaacaagtaaccgagggactcaccaaagaccccaaaaccctgccggcccttcttttctacagcggcgatggcatccagcactggacgcgccactcgtgcgccccggatttctacccccgccgcgaggagatcaacatcctccacagcgaagcggctcacatggcggcctcgataagccaggacagtgttgtggtggatctgggcagcgcatccctcgataaagtcctccccttcctgcacgccctcgaggcccaacagaagcgcgttcactactacgccctcgacctgagctacccggtgctcgcctcgacgctgtccgagatccccgtggcgcagttccagtatgtccagatcgccgcgctgcacggcaccttcgaggacgggctgcagtggctgcacgactcgcccgaggtccgcgagcgcccccaccacctgctgctgttcggcctcacgatcggcaacttctcacggcccaacgccgccgcctttttacggaatatcgccgaccgggcgctggcggcgtcccccgcggagagctccatcctcctcaccctggacagctgcaagatgccgaccaaggtgctgcgcgcgtacacggcggaaggggtggtgcctttcgcgctgacctcgttgagctatgccaatcagctcttctggccgggtggggagggaagggtgtttgatgaagaggaatggtatttccacagtgagtggaacttcgcgctggggcgccacgaggcggcgctcatcccccgggatcgcgatatcaccctcgggccgccgttggagcaggtcgtcgtgcgccggggtgagaaggtgaggtttggctgcagctacaagtatagtgctgcggagcgggagcatttgttcgctggggcggggttggagaatgtggcttcctggtcggccaagggctgtgatgttgctttttatcagttgaagatgcggcccgagtga

SEQ ID NO: 143 - DNA, 855 bp, Aspergillus japonicus
atgaccatcctcgtcctcggcggccgcggcaagaccgccagccgcctctcagccctcctgcacgaagcccagatccccttcgtcgtgggcacctcctccacggccccgatcgccacctaccgaaccgcccacttcgactggctgaacaaagacacctggaccaacgcgtgggaccaggccccggagcccatcaccgctatctacctcgtaggcgcccacgccccggagttcgtgcacccgatgttcgagttcatcgacctggcgcacagccggggcgtgcggcggtacgcgctcgtcagcgcgagcaacaccgaaaagggggatccgatgatgggggaggcgcacgcgcacctggactcgaaagagggggtcaagtatgtggtgttgcggccgacgtggtttatggaaaaccacatcgaagacccccacctcagctggatcaagacggagaacaagatctactcggccacgggcccgggcaagatccccttcgtctcggcggatgatatcgcccgcgtcgccttccacgccctgacgcagccgctcacccagaaggagcagcagtacatggttctgggcccggatctgctgtcctatgctgatatggccgagatcctcaccgacctcctgggccggaagattacgcacgtcaccctgcccgccgagaagttcggccagttcctggtcgacacggccgggttgcccccggactttgcggagatgctggcgacgatggaggcggcggtggcgacgggggcggaggagcgggtcagccaagatgtcgagaaggtgaccgggcggccgccgcggcggtttgtggattacgcgagggagaatcgcgagcattggttgtga

SEQ ID NO: 144 - DNA, 882 bp, Aspergillus japonicus
atgaccatcaccgagacctccaagccgacgctgcgccgcatcccccggagcgccggcgacgaggccatcttccaagtcctgcaggaagacggagtcgtcgtgatcgaaggattcatgagcgcggaccaggtccgccgcttcaacggggagatcgacccgcacatgaagcagtgggaactgggccagaagtcgtaccaggagagctacctggcggggatgcgacagctgagcagcctgccgctgttcagcaagctcttccgggacgagctgatgaacgacgagctcctgcacgggctgtgcaagcggctgttcgggcccgagtccggcgactactggctgacgacctcctcggtgctggagacagagccgggctaccacgggcaggagctgcaccgcgagcacgacgggatccccatctgcaccaccctgggccgccagagccccgagtccatgctcaacttcctcaccgcgctgaccgacttcaccgcggagaacggcgccacccgcgtcctgccgggcagtcacctctgggaggacttcagcgccccgccccccaaggccgacaccgccatccccgccgtcatgaaccccggcgatgccgttctcttcaccggcaagaccctgcacggcgccggcaagaacaacaccaccgacttcctgcgccgcggcttccccctgatcatgcagtcgtgccagttcacccctgtcgaggcctcggtggccctgccccgtgagctggtcgagaccatgacccccctggcccagaagatggtcggctggcggaccgtctccgctaagggggtggatatctggacgtatgatctgaaggatctggcgacaggaattgatctcaagtcgaaccaggtggcgaaaaaggcgtga

SEQ ID NO: 145 - protein, 31 aa, Artificial Sequence
  DmaW pattern 1_SeqID 145
  MISC_FEATURE (2)..(2): Xaa can be any naturally occurring amino acid
  MISC_FEATURE (12)..(12): Xaa can be any naturally occurring amino acid
  MISC_FEATURE (13)..(13): Xaa can be any naturally occurring amino acid
  MISC_FEATURE (14)..(14): Xaa can be any naturally occurring amino acid
  MISC_FEATURE (15)..(15): Xaa can be any naturally occurring amino acid
  MISC_FEATURE (17)..(17): Xaa can be any naturally occurring amino acid
  MISC_FEATURE (18)..(18): Xaa can be any naturally occurring amino acid
  MISC_FEATURE (20)..(20): Xaa can be any naturally occurring amino acid
  MISC_FEATURE (22)..(22): Xaa can be any naturally occurring amino acid
  MISC_FEATURE (25)..(25): Xaa can be any naturally occurring amino acid
  MISC_FEATURE (28)..(28): Xaa can be any naturally occurring amino acid
  MISC_FEATURE (29)..(29): Xaa can be any naturally occurring amino acid
IXTQNKLALDLXXXXFXXKXYXYPXLKXXTG

SEQ ID NO: 146 - protein, 91 aa, Artificial Sequence
  DmaW pattern 2
  MISC_FEATURE (3)..(3): Xaa can be any naturally occurring amino acid
  MISC_FEATURE (8)..(9): Xaa can be any naturally occurring amino acid
  MISC_FEATURE (11)..(11): Xaa can be any naturally occurring amino acid
  MISC_FEATURE (14)..(14): Xaa can be any naturally occurring amino acid
  MISC_FEATURE (18)..(19): Xaa can be any naturally occurring amino acid
  MISC_FEATURE (21)..(22): Xaa can be any naturally occurring amino acid
  MISC_FEATURE (24)..(24): Xaa can be any naturally occurring amino acid
  MISC_FEATURE (26)..(28): Xaa can be any naturally occurring amino acid
  MISC_FEATURE (34)..(34): Xaa can be any naturally occurring amino acid
  MISC_FEATURE (37)..(39): Xaa can be any naturally occurring amino acid
  MISC_FEATURE (41)..(42): Xaa can be any naturally occurring amino acid
  MISC_FEATURE (44)..(45): Xaa can be any naturally occurring amino acid
  MISC_FEATURE (48)..(49): Xaa can be any naturally occurring amino acid
  MISC_FEATURE (55)..(55): Xaa can be any naturally occurring amino acid
  MISC_FEATURE (57)..(65): Xaa can be any naturally occurring amino acid
  MISC_FEATURE (68)..(70): Xaa can be any naturally occurring amino acid
  MISC_FEATURE (72)..(73): Xaa can be any naturally occurring amino acid
  MISC_FEATURE (75)..(76): Xaa can be any naturally occurring amino acid
  MISC_FEATURE (77)..(77): Xaa can be any naturally occurring amino acid
  misc_feature (78)..(78): Xaa can be any naturally occurring amino acid
  MISC_FEATURE (80)..(80): Xaa can be any naturally occurring amino acid
  MISC_FEATURE (83)..(83): Xaa can be any naturally occurring amino acid
  MISC_FEATURE (85)..(85): Xaa can be any naturally occurring amino acid
  MISC_FEATURE (87)..(87): Xaa can be any naturally occurring amino acid
  MISC_FEATURE (89)..(90): Xaa can be any naturally occurring amino acid
RLXSCDLXXPXSRXKIYXXEXXVXLXXXEDLWTXGGXXXDXXTXXGLXXLRELWXLXXXXXXXXXYPXXXLXXGXXPXEXLPXMXNXTXXH

SEQ ID NO: 147 - protein, 444 aa, Artificial Sequence
  DmaW consensus
  misc_feature (2)..(4): Xaa can be any naturally occurring amino acid
  misc_feature (6)..(10): Xaa can be any naturally occurring amino acid
  misc_feature (13)..(13): Xaa can be any naturally occurring amino acid
  misc_feature (17)..(18): Xaa can be any naturally occurring amino acid
  misc_feature (22)..(25): Xaa can be any naturally occurring amino acid
  misc_feature (27)..(27): Xaa can be any naturally occurring amino acid
  misc_feature (39)..(39): Xaa can be any naturally occurring amino acid
  misc_feature (45)..(45): Xaa can be any naturally occurring amino acid
  misc_feature (47)..(48): Xaa can be any naturally occurring amino acid
  misc_feature (50)..(50): Xaa can be any naturally occurring amino acid
  misc_feature (53)..(53): Xaa can be any naturally occurring amino acid
  misc_feature (61)..(62): Xaa can be any naturally occurring amino acid
  misc_feature (72)..(75): Xaa can be any naturally occurring amino acid
  misc_feature (96)..(96): Xaa can be any naturally occurring amino acid
  misc_feature (98)..(98): Xaa can be any naturally occurring amino acid
  misc_feature (113)..(113): Xaa can be any naturally occurring amino acid
  misc_feature (120)..(120): Xaa can be any naturally occurring amino acid
  misc_feature (124)..(124): Xaa can be any naturally occurring amino acid
  misc_feature (127)..(128): Xaa can be any naturally occurring amino acid
  misc_feature (130)..(132): Xaa can be any naturally occurring amino acid
  misc_feature (134)..(134): Xaa can be any naturally occurring amino acid
  misc_feature (142)..(142): Xaa can be any naturally occurring amino acid
  misc_feature (146)..(147): Xaa can be any naturally occurring amino acid
  misc_feature (151)..(153): Xaa can be any naturally occurring amino acid
  misc_feature (159)..(160): Xaa can be any naturally occurring amino acid
  misc_feature (163)..(163): Xaa can be any naturally occurring amino acid
  misc_feature (166)..(167): Xaa can be any naturally occurring amino acid
  misc_feature (182)..(183): Xaa can be any naturally occurring amino acid
  misc_feature (197)..(197): Xaa can be any naturally occurring amino acid
  misc_feature (203)..(203): Xaa can be any naturally occurring amino acid
  misc_feature (207)..(207): Xaa can be any naturally occurring amino acid
  misc_feature (212)..(212): Xaa can be any naturally occurring amino acid
  misc_feature (216)..(218): Xaa can be any naturally occurring amino acid
  misc_feature (222)..(223): Xaa can be any naturally occurring amino acid
  misc_feature (226)..(227): Xaa can be any naturally occurring amino acid
  misc_feature (230)..(230): Xaa can be any naturally occurring amino acid
  misc_feature (233)..(233): Xaa can be any naturally occurring amino acid
  misc_feature (237)..(246): Xaa can be any naturally occurring amino acid
  misc_feature (249)..(249): Xaa can be any naturally occurring amino acid
  misc_feature (259)..(259): Xaa can be any naturally occurring amino acid
  misc_feature (262)..(262): Xaa can be any naturally occurring amino acid
  misc_feature (278)..(278): Xaa can be any naturally occurring amino acid
  misc_feature (291)..(291): Xaa can be any naturally occurring amino acid
  misc_feature (293)..(293): Xaa can be any naturally occurring amino acid
  misc_feature (297)..(297): Xaa can be any naturally occurring amino acid
  misc_feature (307)..(307): Xaa can be any naturally occurring amino acid
  misc_feature (309)..(310): Xaa can be any naturally occurring amino acid
  misc_feature (313)..(313): Xaa can be any naturally occurring amino acid
  misc_feature (316)..(317): Xaa can be any naturally occurring amino acid
  misc_feature (320)..(320): Xaa can be any naturally occurring amino acid
  misc_feature (324)..(324): Xaa can be any naturally occurring amino acid
  misc_feature (327)..(327): Xaa can be any naturally occurring amino acid
  misc_feature (330)..(330): Xaa can be any naturally occurring amino acid
  misc_feature (344)..(344): Xaa can be any naturally occurring amino acid
  misc_feature (347)..(347): Xaa can be any naturally occurring amino acid
  misc_feature (356)..(356): Xaa can be any naturally occurring amino acid
  misc_feature (362)..(366): Xaa can be any naturally occurring amino acid
  misc_feature (378)..(379): Xaa can be any naturally occurring amino acid
  misc_feature (382)..(383): Xaa can be any naturally occurring amino acid
  misc_feature (386)..(387): Xaa can be any naturally occurring amino acid
  misc_feature (389)..(391): Xaa can be any naturally occurring amino acid
  misc_feature (395)..(395): Xaa can be any naturally occurring amino acid
  misc_feature (397)..(397): Xaa can be any naturally occurring amino acid
  misc_feature (399)..(399): Xaa can be any naturally occurring amino acid
  misc_feature (413)..(413): Xaa can be any naturally occurring amino acid
  misc_feature (432)..(439): Xaa can be any naturally occurring amino acid
  misc_feature (441)..(443): Xaa can be any naturally occurring amino acid
MXXXNXXXXXVYXTLSXXFDFXXXXQXLWWHSTAPMFAXMLQTAXYXXHXQYXHLGIYKKXXIPFLGVYPTXXXXRWLSILTRYGTPFELSLNCSXSXVRYTYEPINAATGTXKDPFNTXAIWXSLXXLXXXQXGIDLEWFXYFKXXLTLXXXESAYLXXNNXLVXXQIKTQNKLALDLKGXXFVLKTYIYPALKSXATGKSXHELXFGSVXRLSXXXPSIXXPLXXLEXYVXSRGXXXXXXXXXXSTXSPRLLSCDLXDPXKSRVKIYLLERMVSLXAMEDLWTLGGRRXDXSTLXGLEMIRELWXLXXLPXGLXXYPXPYLXLGXIPXEQLPLMANYTLHHXDPXPEPQVYFTXFGMNDXXXXXALTTFFERRGWXXMAXXYKXXLXXXYPHXDXEXLNYLHAYISFSYRXNKPYLSVYLHSFETGDWPXXXXXXXXFXXXR

SEQ ID NO: 148 - protein, 64 aa, Artificial Sequence
  EasA patern 1
  misc_feature (2)..(2): Xaa can be any naturally occurring amino acid
  misc_feature (5)..(8): Xaa can be any naturally occurring amino acid
  misc_feature (13)..(15): Xaa can be any naturally occurring amino acid
  misc_feature (17)..(18): Xaa can be any naturally occurring amino acid
  misc_feature (20)..(24): Xaa can be any naturally occurring amino acid
  misc_feature (26)..(29): Xaa can be any naturally occurring amino acid
  misc_feature (31)..(40): Xaa can be any naturally occurring amino acid
  misc_feature (42)..(47): Xaa can be any naturally occurring amino acid
  misc_feature (50)..(54): Xaa can be any naturally occurring amino acid
  misc_feature (56)..(57): Xaa can be any naturally occurring amino acid
  misc_feature (60)..(62): Xaa can be any naturally occurring amino acid
YXQRXXXXGTLLXXXAXXIXXXXXGXXXXPXXXXXXXXXXWXXXXXXVHXXXXXIXXQLXXXGR

SEQ ID NO: 149 - protein, 45 aa, Artificial Sequence
  EasA patern 2
  misc_feature (2)..(5): Xaa can be any naturally occurring amino acid
  misc_feature (9)..(9): Xaa can be any naturally occurring amino acid
  misc_feature (11)..(11): Xaa can be any naturally occurring amino acid
  misc_feature (13)..(14): Xaa can be any naturally occurring amino acid
  misc_feature (18)..(18): Xaa can be any naturally occurring amino acid
  misc_feature (20)..(20): Xaa can be any naturally occurring amino acid
  misc_feature (24)..(24): Xaa can be any naturally occurring amino acid
  misc_feature (26)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (34)..(35): Xaa can be any naturally occurring amino acid
  misc_feature (38)..(41): Xaa can be any naturally occurring amino acid
  misc_feature (43)..(43): Xaa can be any naturally occurring amino acid
AXXXXFDGXEXHXXANGXLXDQFXQXXXNXRXDXXGGXXXXRXRF

SEQ ID NO: 150 - protein, 12 aa, Artificial Sequence
  EasA patern 3
  misc_feature (3)..(5): Xaa can be any naturally occurring amino acid
  misc_feature (7)..(7): Xaa can be any naturally occurring amino acid
GRXXXSXPDLPF

SEQ ID NO: 151 - protein, 496 aa, Artificial Sequence
  EasC consensus
  misc_feature (2)..(4): Xaa can be any naturally occurring amino acid
  misc_feature (6)..(7): Xaa can be any naturally occurring amino acid
  misc_feature (17)..(18): Xaa can be any naturally occurring amino acid
  misc_feature (22)..(25): Xaa can be any naturally occurring amino acid
  misc_feature (27)..(30): Xaa can be any naturally occurring amino acid
  misc_feature (32)..(32): Xaa can be any naturally occurring amino acid
  misc_feature (34)..(34): Xaa can be any naturally occurring amino acid
  misc_feature (36)..(36): Xaa can be any naturally occurring amino acid
  misc_feature (41)..(41): Xaa can be any naturally occurring amino acid
  misc_feature (70)..(70): Xaa can be any naturally occurring amino acid
  misc_feature (77)..(77): Xaa can be any naturally occurring amino acid
  misc_feature (89)..(89): Xaa can be any naturally occurring amino acid
  misc_feature (120)..(120): Xaa can be any naturally occurring amino acid
  misc_feature (128)..(128): Xaa can be any naturally occurring amino acid
  misc_feature (131)..(131): Xaa can be any naturally occurring amino acid
  misc_feature (144)..(144): Xaa can be any naturally occurring amino acid
  misc_feature (158)..(158): Xaa can be any naturally occurring amino acid
  misc_feature (169)..(169): Xaa can be any naturally occurring amino acid
  misc_feature (179)..(179): Xaa can be any naturally occurring amino acid
  misc_feature (189)..(189): Xaa can be any naturally occurring amino acid
  misc_feature (226)..(227): Xaa can be any naturally occurring amino acid
  misc_feature (229)..(230): Xaa can be any naturally occurring amino acid
  misc_feature (232)..(233): Xaa can be any naturally occurring amino acid
  misc_feature (236)..(237): Xaa can be any naturally occurring amino acid
  misc_feature (241)..(241): Xaa can be any naturally occurring amino acid
  misc_feature (271)..(271): Xaa can be any naturally occurring amino acid
  misc_feature (288)..(288): Xaa can be any naturally occurring amino acid
  misc_feature (291)..(291): Xaa can be any naturally occurring amino acid
  misc_feature (294)..(295): Xaa can be any naturally occurring amino acid
  misc_feature (300)..(300): Xaa can be any naturally occurring amino acid
  misc_feature (311)..(311): Xaa can be any naturally occurring amino acid
  misc_feature (356)..(356): Xaa can be any naturally occurring amino acid
  misc_feature (359)..(360): Xaa can be any naturally occurring amino acid
  misc_feature (365)..(366): Xaa can be any naturally occurring amino acid
  misc_feature (368)..(369): Xaa can be any naturally occurring amino acid
  misc_feature (371)..(371): Xaa can be any naturally occurring amino acid
  misc_feature (373)..(374): Xaa can be any naturally occurring amino acid
  misc_feature (378)..(382): Xaa can be any naturally occurring amino acid
  misc_feature (388)..(388): Xaa can be any naturally occurring amino acid
  misc_feature (390)..(390): Xaa can be any naturally occurring amino acid
  misc_feature (392)..(392): Xaa can be any naturally occurring amino acid
  misc_feature (394)..(397): Xaa can be any naturally occurring amino acid
  misc_feature (399)..(399): Xaa can be any naturally occurring amino acid
  misc_feature (402)..(403): Xaa can be any naturally occurring amino acid
  misc_feature (406)..(408): Xaa can be any naturally occurring amino acid
  misc_feature (412)..(413): Xaa can be any naturally occurring amino acid
  misc_feature (417)..(417): Xaa can be any naturally occurring amino acid
  misc_feature (419)..(419): Xaa can be any naturally occurring amino acid
  misc_feature (421)..(421): Xaa can be any naturally occurring amino acid
  misc_feature (424)..(427): Xaa can be any naturally occurring amino acid
  misc_feature (429)..(429): Xaa can be any naturally occurring amino acid
  misc_feature (439)..(440): Xaa can be any naturally occurring amino acid
  misc_feature (443)..(444): Xaa can be any naturally occurring amino acid
  misc_feature (446)..(446): Xaa can be any naturally occurring amino acid
  misc_feature (452)..(452): Xaa can be any naturally occurring amino acid
  misc_feature (455)..(455): Xaa can be any naturally occurring amino acid
  misc_feature (459)..(459): Xaa can be any naturally occurring amino acid
  misc_feature (464)..(466): Xaa can be any naturally occurring amino acid
  misc_feature (474)..(474): Xaa can be any naturally occurring amino acid
  misc_feature (477)..(477): Xaa can be any naturally occurring amino acid
  misc_feature (481)..(481): Xaa can be any naturally occurring amino acid
  misc_feature (485)..(485): Xaa can be any naturally occurring amino acid
  misc_feature (489)..(489): Xaa can be any naturally occurring amino acid
  misc_feature (493)..(493): Xaa can be any naturally occurring amino acid
AXXXSXXYTTSNGCPVXXPEGXXXXGXXXXLXLXDXHLIDXLAHFNREKIPERAVHAKGAGAYGEFEVTXDISDICXIDMLLGVGKKTXCVTRFSTTGLERGSADSVRDLKGMAVKFYTXEGNWDWVXLNXPMFFIRDPSKFPXLIHAQRRDPQTNLXNPSMFWDFVTXNHEALHMVMXQFSDFGTMFXYRSMSGYVGHAYKWVMPDGSFKYVHIFLSSDQGPNFXXGXXAXXIAXXDPDXATRDLYEAIERGEYPSWTANVQVVDPEDAXKLGFNILDVTKHWNLGXYPXDLXXIPSRXFGKLTLNKNPXNYFAEIEQLAFSPSHLVPGVEPSEDPILQARLFAYPDAQRYRLGXNHXXIPVNXXKXXFXPXXRDGXXXXXGNYGAXPXYXSXXXXMXFAXXKSXXXPEHXXWLSXVXSXSWXXXXEXDYKFAREFWXXLPXXRXQEFQDXMVXNMAXSVAQXXXELRKKVYXTFXLVAXDLAXRVKXGTEXLVA

SEQ ID NO: 152 - protein, 266 aa, Artificial Sequence
  EasD consensus
  misc_feature (28)..(28): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(48): Xaa can be any naturally occurring amino acid
  misc_feature (75)..(75): Xaa can be any naturally occurring amino acid
  misc_feature (78)..(78): Xaa can be any naturally occurring amino acid
  misc_feature (112)..(112): Xaa can be any naturally occurring amino acid
  misc_feature (114)..(114): Xaa can be any naturally occurring amino acid
  misc_feature (117)..(117): Xaa can be any naturally occurring amino acid
  misc_feature (121)..(121): Xaa can be any naturally occurring amino acid
  misc_feature (143)..(145): Xaa can be any naturally occurring amino acid
  misc_feature (147)..(147): Xaa can be any naturally occurring amino acid
  misc_feature (182)..(182): Xaa can be any naturally occurring amino acid
  misc_feature (191)..(191): Xaa can be any naturally occurring amino acid
  misc_feature (197)..(197): Xaa can be any naturally occurring amino acid
  misc_feature (202)..(202): Xaa can be any naturally occurring amino acid
  misc_feature (213)..(213): Xaa can be any naturally occurring amino acid
  misc_feature (215)..(215): Xaa can be any naturally occurring amino acid
  misc_feature (223)..(223): Xaa can be any naturally occurring amino acid
  misc_feature (225)..(225): Xaa can be any naturally occurring amino acid
MASVSSKIFAITGGASGIGAATCRLLAXRGAAVICVGDVSSXNFXSLXKSIKEINPSTKVHCTVLDVSSSSEVDXWLXDIISTFGDLHGAANVAGIAQGAGLRQTPTILEEXDXEWXRIFXVNLDGVFYSTRAQVRAMKDLPXXXGXDRSIVNVASIAAFSHMPDVYAYGTSKAACAYFTTXCVAADVFPXGIRVNXVSPGXITNTPLLPQFXPXAKSLDEVXEXYKKEGFSVIEADDVARTIVWLLSEDSRPVYGANINVGACMP

SEQ ID NO: 153 - protein, 609 aa, Artificial Sequence
  EasE consensus
  misc_feature (2)..(3): Xaa can be any naturally occurring amino acid
  misc_feature (6)..(12): Xaa can be any naturally occurring amino acid
  misc_feature (14)..(16): Xaa can be any naturally occurring amino acid
  misc_feature (18)..(26): Xaa can be any naturally occurring amino acid
  misc_feature (34)..(34): Xaa can be any naturally occurring amino acid
  misc_feature (39)..(41): Xaa can be any naturally occurring amino acid
  misc_feature (43)..(43): Xaa can be any naturally occurring amino acid
  misc_feature (45)..(45): Xaa can be any naturally occurring amino acid
  misc_feature (47)..(47): Xaa can be any naturally occurring amino acid
  misc_feature (52)..(52): Xaa can be any naturally occurring amino acid
  misc_feature (54)..(55): Xaa can be any naturally occurring amino acid
  misc_feature (61)..(61): Xaa can be any naturally occurring amino acid
  misc_feature (65)..(65): Xaa can be any naturally occurring amino acid
  misc_feature (67)..(67): Xaa can be any naturally occurring amino acid
  misc_feature (70)..(70): Xaa can be any naturally occurring amino acid
  misc_feature (74)..(75): Xaa can be any naturally occurring amino acid
  misc_feature (78)..(78): Xaa can be any naturally occurring amino acid
  misc_feature (92)..(92): Xaa can be any naturally occurring amino acid
  misc_feature (102)..(102): Xaa can be any naturally occurring amino acid
  misc_feature (113)..(113): Xaa can be any naturally occurring amino acid
  misc_feature (115)..(116): Xaa can be any naturally occurring amino acid
  misc_feature (118)..(120): Xaa can be any naturally occurring amino acid
  misc_feature (138)..(138): Xaa can be any naturally occurring amino acid
  misc_feature (142)..(142): Xaa can be any naturally occurring amino acid
  misc_feature (163)..(163): Xaa can be any naturally occurring amino acid
  misc_feature (184)..(184): Xaa can be any naturally occurring amino acid
  misc_feature (187)..(187): Xaa can be any naturally occurring amino acid
  misc_feature (192)..(192): Xaa can be any naturally occurring amino acid
  misc_feature (195)..(198): Xaa can be any naturally occurring amino acid
  misc_feature (203)..(203): Xaa can be any naturally occurring amino acid
  misc_feature (220)..(220): Xaa can be any naturally occurring amino acid
  misc_feature (224)..(224): Xaa can be any naturally occurring amino acid
  misc_feature (255)..(256): Xaa can be any naturally occurring amino acid
  misc_feature (272)..(272): Xaa can be any naturally occurring amino acid
  misc_feature (322)..(322): Xaa can be any naturally occurring amino acid
  misc_feature (324)..(325): Xaa can be any naturally occurring amino acid
  misc_feature (327)..(327): Xaa can be any naturally occurring amino acid
  misc_feature (333)..(333): Xaa can be any naturally occurring amino acid
  misc_feature (337)..(337): Xaa can be any naturally occurring amino acid
  misc_feature (357)..(360): Xaa can be any naturally occurring amino acid
  misc_feature (369)..(369): Xaa can be any naturally occurring amino acid
  misc_feature (378)..(378): Xaa can be any naturally occurring amino acid
  misc_feature (380)..(380): Xaa can be any naturally occurring amino acid
  misc_feature (383)..(383): Xaa can be any naturally occurring amino acid
  misc_feature (388)..(388): Xaa can be any naturally occurring amino acid
  misc_feature (391)..(391): Xaa can be any naturally occurring amino acid
  misc_feature (394)..(395): Xaa can be any naturally occurring amino acid
  misc_feature (398)..(398): Xaa can be any naturally occurring amino acid
  misc_feature (401)..(401): Xaa can be any naturally occurring amino acid
  misc_feature (405)..(405): Xaa can be any naturally occurring amino acid
  misc_feature (408)..(409): Xaa can be any naturally occurring amino acid
  misc_feature (412)..(412): Xaa can be any naturally occurring amino acid
  misc_feature (415)..(416): Xaa can be any naturally occurring amino acid
  misc_feature (424)..(424): Xaa can be any naturally occurring amino acid
  misc_feature (429)..(429): Xaa can be any naturally occurring amino acid
  misc_feature (437)..(437): Xaa can be any naturally occurring amino acid
  misc_feature (440)..(440): Xaa can be any naturally occurring amino acid
  misc_feature (446)..(446): Xaa can be any naturally occurring amino acid
  misc_feature (450)..(451): Xaa can be any naturally occurring amino acid
  misc_feature (454)..(454): Xaa can be any naturally occurring amino acid
  misc_feature (460)..(460): Xaa can be any naturally occurring amino acid
  misc_feature (477)..(478): Xaa can be any naturally occurring amino acid
  misc_feature (503)..(503): Xaa can be any naturally occurring amino acid
  misc_feature (512)..(512): Xaa can be any naturally occurring amino acid
  misc_feature (516)..(516): Xaa can be any naturally occurring amino acid
  misc_feature (520)..(520): Xaa can be any naturally occurring amino acid
  misc_feature (531)..(531): Xaa can be any naturally occurring amino acid
  misc_feature (554)..(554): Xaa can be any naturally occurring amino acid
  misc_feature (556)..(556): Xaa can be any naturally occurring amino acid
  misc_feature (562)..(562): Xaa can be any naturally occurring amino acid
  misc_feature (583)..(583): Xaa can be any naturally occurring amino acid
  misc_feature (593)..(596): Xaa can be any naturally occurring amino acid
  misc_feature (598)..(599): Xaa can be any naturally occurring amino acid
  misc_feature (601)..(601): Xaa can be any naturally occurring amino acid
  misc_feature (603)..(603): Xaa can be any naturally occurring amino acid
  misc_feature (605)..(606): Xaa can be any naturally occurring amino acid
  misc_feature (608)..(608): Xaa can be any naturally occurring amino acid
MXXLVXXXXXXXLXXXLXXXXXXXXXCRCRPWEXCWPSXXXWXSXNXSIDGXLXXLRPIAXVCHXPXFDXSACXXLLXLSRDSGWRASNPGXLQDWVWEAGXTANESCPVGSXRXXSXXXSCHQGRIPLYSAAVESTXQVQXAVRFARRHNLRLVIRNTGHDXAGRSSAPDSFQIHTHRLQEIXFHXNFRLXGSXXXXTSLGXPAVTVGAGVMMGELYAXGARXGYMVLGGECPTVGVVGGFLQGGGVSSFLSFXXGLAVDNVLEYEVVTAXGELVVANAHQNQDLFWALRGGGGGTFGVVTRATMRVFPDVPVVVSEILLXAXXAXSSFWTXGLSXLLTALQSLNQDNVGGQLVIXXXXKDAVQASIXLFFLNMTEXAXIDXRMKPXLTXLSXXNIXYTXSSKXLPXXSSXLRXXPDIHPDNXYGILXSSVLISQXLFXSSEGPXKVAXXLAXLPMSPXDLLFTSNLGGRVIANGXXELAETSMHPAWRSAAQLINYVRTVXEPSIEGKAXALEXLTNXQMPILYAIDPXFKLSYRNLGDPNEKDFQQVYWGXNXYGRLSXIKKKWDPDDLFFSKLGVGSEXWDSEGMCRKXXXXQXXLXQXLXXLXS

SEQ ID NO: 154 - protein, 344 aa, Artificial Sequence
  EasF consensus
  misc_feature (2)..(3): Xaa can be any naturally occurring amino acid
  misc_feature (5)..(5): Xaa can be any naturally occurring amino acid
  misc_feature (11)..(11): Xaa can be any naturally occurring amino acid
  misc_feature (13)..(13): Xaa can be any naturally occurring amino acid
  misc_feature (24)..(24): Xaa can be any naturally occurring amino acid
  misc_feature (27)..(27): Xaa can be any naturally occurring amino acid
  misc_feature (29)..(29): Xaa can be any naturally occurring amino acid
  misc_feature (45)..(45): Xaa can be any naturally occurring amino acid
  misc_feature (64)..(64): Xaa can be any naturally occurring amino acid
  misc_feature (68)..(68): Xaa can be any naturally occurring amino acid
  misc_feature (71)..(71): Xaa can be any naturally occurring amino acid
  misc_feature (79)..(79): Xaa can be any naturally occurring amino acid
  misc_feature (105)..(105): Xaa can be any naturally occurring amino acid
  misc_feature (107)..(107): Xaa can be any naturally occurring amino acid
  misc_feature (121)..(121): Xaa can be any naturally occurring amino acid
  misc_feature (125)..(125): Xaa can be any naturally occurring amino acid
  misc_feature (130)..(130): Xaa can be any naturally occurring amino acid
  misc_feature (132)..(132): Xaa can be any naturally occurring amino acid
  misc_feature (150)..(150): Xaa can be any naturally occurring amino acid
  misc_feature (153)..(153): Xaa can be any naturally occurring amino acid
  misc_feature (189)..(189): Xaa can be any naturally occurring amino acid
  misc_feature (193)..(193): Xaa can be any naturally occurring amino acid
  misc_feature (195)..(195): Xaa can be any naturally occurring amino acid
  misc_feature (197)..(198): Xaa can be any naturally occurring amino acid
  misc_feature (240)..(241): Xaa can be any naturally occurring amino acid
  MISC_FEATURE (243)..(254): the stretch of X between amino acid position 243 and 254 can be between 4 X and 12 X
  misc_feature (286)..(286): Xaa can be any naturally occurring amino acid
  misc_feature (293)..(293): Xaa can be any naturally occurring amino acid
  misc_feature (312)..(313): Xaa can be any naturally occurring amino acid
  misc_feature (316)..(316): Xaa can be any naturally occurring amino acid
  misc_feature (320)..(320): Xaa can be any naturally occurring amino acid
  misc_feature (328)..(329): Xaa can be any naturally occurring amino acid
  misc_feature (332)..(332): Xaa can be any naturally occurring amino acid
MXXPXVIDIRXSXFEDSIPDQVIXGLXSXPKTLPALLFYSNEGLXHWNHHSHQPDFYPRHQEIXILKXKAXEMAASIAXNSVVVDLGSASLDKVIHLLEALEAQXKXVTYYALDLSASQLXSTLXAIPTXQXFRHVRFAGLHGTFDDGLXWLXETPEIRDLPHCVLLFGLTIGNFSRPNAAAFLRNIAXHALXGXSXXQSSILLSLDSCKVPTQVLRAYTAEGVVPFALQSLTYANTLFXXKXXXXXXXXXXXXVFNPDDWYYLSEWNFVLGRHEASLIPRSKDIXLGAPLDXIVVRKDEKVRFGCSYKYDXXERXELFXAAGLKDEXXWSXEGCDVAFYQLKL

SEQ ID NO: 155 - protein, 318 aa, Artificial Sequence
  EasG consensus
  misc_feature (21)..(22): Xaa can be any naturally occurring amino acid
  misc_feature (24)..(26): Xaa can be any naturally occurring amino acid
  misc_feature (38)..(41): Xaa can be any naturally occurring amino acid
  misc_feature (46)..(48): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(64): Xaa can be any naturally occurring amino acid
  misc_feature (66)..(70): Xaa can be any naturally occurring amino acid
  misc_feature (73)..(73): Xaa can be any naturally occurring amino acid
  misc_feature (82)..(82): Xaa can be any naturally occurring amino acid
  misc_feature (86)..(86): Xaa can be any naturally occurring amino acid
  misc_feature (124)..(124): Xaa can be any naturally occurring amino acid
  misc_feature (133)..(133): Xaa can be any naturally occurring amino acid
  misc_feature (137)..(137): Xaa can be any naturally occurring amino acid
  misc_feature (139)..(139): Xaa can be any naturally occurring amino acid
  misc_feature (152)..(154): Xaa can be any naturally occurring amino acid
  misc_feature (160)..(160): Xaa can be any naturally occurring amino acid
  misc_feature (163)..(163): Xaa can be any naturally occurring amino acid
  misc_feature (182)..(182): Xaa can be any naturally occurring amino acid
  misc_feature (196)..(196): Xaa can be any naturally occurring amino acid
  misc_feature (198)..(198): Xaa can be any naturally occurring amino acid
  misc_feature (201)..(201): Xaa can be any naturally occurring amino acid
  misc_feature (217)..(235): Xaa can be any naturally occurring amino acid
  misc_feature (259)..(259): Xaa can be any naturally occurring amino acid
  misc_feature (262)..(263): Xaa can be any naturally occurring amino acid
  misc_feature (265)..(265): Xaa can be any naturally occurring amino acid
  misc_feature (269)..(269): Xaa can be any naturally occurring amino acid
  misc_feature (273)..(273): Xaa can be any naturally occurring amino acid
  misc_feature (281)..(281): Xaa can be any naturally occurring amino acid
  misc_feature (284)..(284): Xaa can be any naturally occurring amino acid
  misc_feature (292)..(294): Xaa can be any naturally occurring amino acid
  misc_feature (297)..(297): Xaa can be any naturally occurring amino acid
  misc_feature (301)..(302): Xaa can be any naturally occurring amino acid
  misc_feature (312)..(312): Xaa can be any naturally occurring amino acid
  misc_feature (315)..(316): Xaa can be any naturally occurring amino acid
MTILLTGGRGKTASHIASLLXXAXXXVPFIVASRSSSXXXXSPYRXXXFDWLDEXTYGNXLSXXDXXXXXGMXPISAVWLVXPPIXDLAPPMIKFIDFARSKGVKRFVLLSASTIEKGGPAMGXIHAHLDSLXEGIXYXVLRPTWFMENFSXXXELQWIXIRXENKIYSATGDGKIPFISVXDIARVAFRALTDEXSXNTXDYVLLGPELLTYDDVXXXXXXXXXXXXXXXXXXXAEILSTVLGRKITHVKLTEAELAXKLXXEXGMPXDDAXMLASMDTXVKXGAEERLNXXXVKXVTGXXPRTFLDFASXEKXXWL

SEQ ID NO: 156 - protein, 285 aa, Artificial Sequence
  EasH consensus
  misc_feature (3)..(3): Xaa can be any naturally occurring amino acid
  misc_feature (5)..(5): Xaa can be any naturally occurring amino acid
  misc_feature (10)..(10): Xaa can be any naturally occurring amino acid
  misc_feature (14)..(14): Xaa can be any naturally occurring amino acid
  misc_feature (16)..(16): Xaa can be any naturally occurring amino acid
  misc_feature (20)..(21): Xaa can be any naturally occurring amino acid
  misc_feature (33)..(34): Xaa can be any naturally occurring amino acid
  misc_feature (39)..(42): Xaa can be any naturally occurring amino acid
  misc_feature (45)..(46): Xaa can be any naturally occurring amino acid
  misc_feature (49)..(49): Xaa can be any naturally occurring amino acid
  misc_feature (51)..(51): Xaa can be any naturally occurring amino acid
  misc_feature (55)..(55): Xaa can be any naturally occurring amino acid
  misc_feature (57)..(57): Xaa can be any naturally occurring amino acid
  misc_feature (63)..(63): Xaa can be any naturally occurring amino acid
  misc_feature (65)..(65): Xaa can be any naturally occurring amino acid
  misc_feature (68)..(68): Xaa can be any naturally occurring amino acid
  misc_feature (72)..(72): Xaa can be any naturally occurring amino acid
  misc_feature (74)..(74): Xaa can be any naturally occurring amino acid
  misc_feature (85)..(85): Xaa can be any naturally occurring amino acid
  misc_feature (89)..(89): Xaa can be any naturally occurring amino acid
  misc_feature (93)..(94): Xaa can be any naturally occurring amino acid
  misc_feature (99)..(99): Xaa can be any naturally occurring amino acid
  misc_feature (102)..(103): Xaa can be any naturally occurring amino acid
  misc_feature (107)..(107): Xaa can be any naturally occurring amino acid
  misc_feature (122)..(122): Xaa can be any naturally occurring amino acid
  misc_feature (126)..(126): Xaa can be any naturally occurring amino acid
  misc_feature (129)..(129): Xaa can be any naturally occurring amino acid
  misc_feature (146)..(146): Xaa can be any naturally occurring amino acid
  misc_feature (150)..(150): Xaa can be any naturally occurring amino acid
  misc_feature (163)..(163): Xaa can be any naturally occurring amino acid
  misc_feature (180)..(180): Xaa can be any naturally occurring amino acid
  misc_feature (182)..(187): Xaa can be any naturally occurring amino acid
  misc_feature (189)..(189): Xaa can be any naturally occurring amino acid
  misc_feature (194)..(194): Xaa can be any naturally occurring amino acid
  misc_feature (204)..(204): Xaa can be any naturally occurring amino acid
  misc_feature (215)..(217): Xaa can be any naturally occurring amino acid
  misc_feature (242)..(242): Xaa can be any naturally occurring amino acid
  misc_feature (245)..(245): Xaa can be any naturally occurring amino acid
  misc_feature (262)..(262): Xaa can be any naturally occurring amino acid
  misc_feature (269)..(269): Xaa can be any naturally occurring amino acid
  misc_feature (280)..(280): Xaa can be any naturally occurring amino acid
  misc_feature (282)..(283): Xaa can be any naturally occurring amino acid
MTXTXTSKPXLRRXPXSAGXXAIFQVLQEDGVXXIEGFXXXXQVXXFNXEXDPHXKXWELGQXSXQEXYLAXMXQLSSLPLFSKXFRDXLMNXXLLHGXCKXXFGPXSGDYWLTTSSVLETXPGYXGQXLHREHDGIPICTTLGRXSPEXMLNFLTALTDFTXENGATRVLPGSHLWEDXSXXXXXXDXAIPAXMNPGDAVLFXGKTLHGAGKNXXXDFLRRGFPLIMQSCQFTPVEASVAXPRXLVETMTPLAQKMVGWRXVSAKGVXIWTYDLKDLAXGXXLK

SEQ ID NO: 157 - DNA, 870 bp, Artificial Sequence
  EasH of Paecilomyces divaricatus codon optimized for S. cerrevisiae
atgaccgtgaccaaaacttccaagcccgtccttcggcgcttgccgatctccgccggagccgatgccattttccaggttctccaggaggacggcgtcctcatcatcgagggcttcctgacgcccgagcaggtgaagaagtttaacgcggaggtcgacccccacctcaagaagtgggagttgggtcagggttccatgcaagagggctacctcgccaacatgaagcagctgtccagcttgcctctcttcagcaagaccttccgcgacgaccttatgaaccatgacctcctccacggcatctgcaagaaggccttcggtccggattctggtgactactggctgactacgtcctccgtcctggagaccgaccctggctatcccggccaagacttgcatcgggaacacgatggcatccccatctgcaccaccctgggccgtgactcccctgaggccatgctgaacttcctgaccgctctgaccgactttaccgaagagaacggtgccactcgcgtcctgcccggttcccacctgtgggaggattactctaagagcgttagtcccgaccaggcaattcctgccgagatgaatccgggtgacgccgtcttgttcagcggcaagaccctccacggtgccggcaagaaccagtccaaggacttcctccgccgtggcttccccctcattatgcagtcgtgtcagttcactcccgtcgaggccagcgtggctatccctcgctccctggtcgagaccatgacccccctggctcagaagatggtcggctggcgttctgtctcggccaaaggagtggaaatctggacatacgacctcaaggatctggctaagggacttaagctgaaggcgatcgctgctgagtag

SEQ ID NO: 158 - DNA, 867 bp, Saccharomyces cerevisiae
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataa

SEQ ID NO: 159 - DNA, 1658 bp, Artificial Sequence
  T/P cassette including both Asc I sites
ggcgcgccatgcagggatatcagatctgggccgtatacttacatatagtagatgtcaagcgtaggcgcttcccctgccggctgtgagggcgccataaccaaggtatctatagaccgccaatcagcaaactacctccgtacattcatgttgcacccacacatttatacacccagaccgcgacaaattacccataaggttgtttgtgacggcgtcgtacaagagaacgtgggaactttttaggctcaccaaaaaagaaagaaaaaatacgagttgctgacagaagcctcaagaaaaaaaaaattcttcttcgactatgctggaggcagagatgatcgagccggtagttaactatatatagctaaattggttccatcaccttcttttctggtgtcgctccttctagtgctatttctggcttttcctatttttttttttccatttttctttctctctttctaatatataaattctcttgcattttctatttttctctctatctattctacttgtttattcccttcaaggtttttttttaaggagtacttgtttttagaatatacggtcaacgaactataattaactaaacaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggacaaatcgctcttaaatatatacctaaagaacattaaagctatattataagcaaagatacgtaaattttgcttatattattatacacatatcatatttctatatttttaagatttggttatataatgtacgtaatgcaaaggaaataaattttatacattattgaacagcgtccaagtaactacattatgtgcactaatagtttagcgtcgtgaagactttattgtgtcgcgaaaagtaaaaattttaaaaattagagcaccttgaacttgcgaaaaaggttctcatcaactgtttaaaaggaggatatcaggtcctatttctgacaaacaatatacaaatttagtttcaaagcatgcccatgggttaactgatcaatgcatcctgcatggcgcgcc

SEQ ID NO: 160 - DNA, 7599 bp, Artificial Sequence
  pEVE2656 (YERC?8-KanMX-G/C+Aj_EasC)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccctgcaggcccagttgtttgtagctggttcatatttagcggcaattctctgttgcgtaaatgaaaatattaatgtaaacaaaaaaagaccaaaacattttagcagtgtaagaaggtgtactgatacaaaatgtgtttagagtctactgatatgttactgaccgttcgttgggaaaaaaatactgtatcatttattaatcaaaagcgacttttggtggaatattatgatatgtgttgttaaaatatgacgtaattttagaattgtctgattcgtattcaaatttggtgaaggaataacgcagagttgacaatttaatagaatggattaatcgtaattttcagaaacgtagaaaaagaaaaacaattaaaacattatattaagattattgatttgccttttaagggtccagcggccgccagctgaagcttcgtacgctgcaggtcgacaacccttaatataacttcgtataatgtatgctatacgaagttattaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggcgcgccagcttgcaaattaaagccttcgagcgtcccaaaaccttctcaagcaaggttttcagtataatgttacatgcgtacacgcgcccagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacggacacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaaagcttaaaatggctccagattctaagccaacttacactactgctaatggttgtccatttcataagcctgaaggtccaccagctgatggtagaactttggctttgtctgatcatcatttggttgataccttggcccatttcaacagagaaaagattccagaaagagttgttcacgctaaaggtgctggtgcttatggtgaatttgaagttactgccgatatctccgatatttgcgatatcgatatgttggttggtgtcggtaaaaagactccatgtgttactagattctctaccactggtttggaaagaggttctaacgaaggtatgagagatttgaaaggtatggcttgtaagttctacactactgaaggtaattgggattgggtcatgttgaatttcccattcttcttcattcgtgatccagtcaagttcccatctttgatgcacgctcaaagaagagatccacaaactaatttgttgaacccaaacatgtactgggattgggttaccaacaatcatgaatccttgcacatggtcttgttgcaattttctgatttcggtactatgttcaattggagatccatgtctggttatatggctcatgcttacaaatgggttaagccagatggttcttttaagtacgtccacatcttcttgtcatctgatagaggtccaaatttcaccgatggtcaacaagctaaaggtacaaatgatttggatccagatcacgctactagagacttgtatgaagctattgaaagaggtgaatacccaacttggactgcttctgttcaagttgttgatccaaaagatgctccaaacttgggttacaacattttggatgttactaagcactggaacttgggtacttacccaaaagatgttactttgatcccaccaaaggttttcggtaagttgactttgaaaagaaacccagctaactacttcgccgaaattgaacaattggcttactctccatctaacatggttccaggtgttgctccatctgaagatccaattttacaagctagaattttcgcttacccagacgctcaaagatatagattgggtgctaaccatcaacaaatcccagttaatagatccgctcatacctttaacccaattgctagagatggtcaaggtacttttgatgctaattatggtgctcatccaggtttcttgactcaacaacaaccagttagatttgccgaacctagagaaccagatccaaagtataatgaatggttgaaagaaatccaatccaagtcctggttgcaaactactgaacatgattacaagttcgccagagatttctacgaagttttgccagattttagaggtcaagaattccaagataccatggtccaaaacatggttgaatctgttgctcaaaccagagccgaaattcaaaagcaagtttacgaaacctggaagttggtttctccagctttggctgctagaattcaaaaaggtgttgaaaccttgttgcaaaagtctgaagctccagctgaagaatcttttattccagctagattgtgaccgcggcacgtccgacggcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgcccgatggatgatgattggttcttatcataatttgatttcggcagaagcaatattagaggtattgttgtaacgaaattccaatgtcatctgcttagtattattaatgttacctgaatattatcacatgctgcttaaaaatgtgttataagtattaaaatctagtgaaagttgaaatgtaatctaataggataatgaaacatatgaaacggaatgaggaataatcgttgtatcactatgtagagatatcgatttcattttgaggattcctatattcttggggagaacttctactatattctgtatacatgatataatagcctctcccaacaatggaatgccaacaacctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 161 - DNA, 1818 bp, Artificial Sequence
  EasE of Neotyphodium lolii codon optimized for S.cerrevisiae
atgagacacttcgttactttcgttgtcggttttttgttgtcctggggtttcttgtcatctttacaagatccaccatcttgtagatgtagaccatgggaaccatgttggccagattctcatcaatggacatctttgaacgcttccattgacggtaatttggttcatgttcaaccagttggttctgtttgtcatgatccacattatgatgctgttgcttgtggtgatgttttggacttgtctagaaattctggttggagagcttctaatccagctacattgcaagattggatttgggaaactggttctggtgataacgaatcttgtttgttggtcagttcttccgaaagaccacaagaaattccatgtcatcaaggtagattgccattatattctgctgctgttaagtctactgcacacgttcaaggtgttattagattcgctaaggatcacaacttgagattggttattaagaacaccggtcatgatgctactggtagatcagctgctccagattctttacaaattcacacctactttttgaaggacatccactacgatgacaatttcttagttcatggtgatgctacaggttctggtccagctgttactttgggtgctggtgttgttcattctgaagtttacaaacatggtatcgaccacaagtactctgttgttggtggtgaatgtccaactgttggtatagttggtggttttttacaaggtggtggtgtttcttcttggtctggttttactagaggtttggctgttgataacgtcttggaataccaagttgttactgctaacgctgaattggttatcgctaacgaacaccaaaatcaagatttgttctgggctttgagaggcggcggtggtggtactttcggtgttgttactcaagctactgttagagcttttccagatgatcctactgttgtttccactttggttttgtcatctactagagctgatacttcattctgggttaaggccatctctagattattgtccattttgagatcctgcaatcaacaaaacgttcacggtcaattgatcatcactagaccatccgttgatattttgaatgctggtttgaccttgcacttctctaatatgaccaacgttttacatgccgaaaccttgttgcaaccacatattgcttcattgtccgaagatcaaatttctaccactttgacctctaagttcgttgccaacattaactccgaattgagattagatgccgatatccatccaagaggtatcggtactttacaaacctccatgatgatctccaacgaattattcggttcttctgaaggtccattgactgttgctcaagtttttggtaaattgccaatcggtccaaacgatttgttgttcacatctaatttgggtggttgcattgctgctaacaaaggtttggatactgctattcatccagcttggagaagttctgctcatttggttacttacgttagatccgttgaaccatccattgaagctaaaaagttggccttgaaagaaatcaccaacaagtacatgccaatcttgtactctatgcaaccatccttcaaggtcagttacagaaacttgggtgatccaaacgaaaagaactaccaagaagttttctggggtgaaaaggtctacaaaagattggcttctattaaggccaagttggatccagatggtttgttcatctctaaattaggtgtcggttctgaagattgggatactgaaggtatgtgttaccaaccacaaaacagagtttctcaaccattgagatcattgaagtactttttgtccgtcttgaaagatacttaa

SEQ ID NO: 162 - DNA, 1866 bp, Artificial Sequence
  EasE of A. japonicus codon optimized for S. cerrevisia Version 1
atgggccaatctaggggcattttaggtggtgtgagacaattgatattagtcattttggtcggagcttatctgtccagactatctgccgtcgatgacgacagacatgattgtcgatgtcgtcctggtgaaccatgctggccaacagtttcacattggtctaccctcaacgaaagcattggtggtgcacttgcacatgttaaaccaatcgctcatgtctgccaccaatctggtcaggacagctctgcttgtgaacaagttttacaagagagtttagactcaaaatggagggcttcccatacaggtgcactgcaagattgggtttgggaaggaggagcagaatctaatcaaacttgctactacctgcgtagtggtcctgctggctcatgtcaccaaggtagaataccactttacagtgcagctgtcaagtctgcctccgatgtgcaaaaggttgttgatttcactagacagcataatttgagattagtcatcagaaatacagggcatgacggatctggtagatcatccggaccagactcagtagagatacacactcaccatttgaactcagtacaatatcatccaaactttagacctgcaggaagctcagaacgacagtctgcacctggtcaacctgctgtgacagtcggcgcaggtatcttacttggtgatctctacgcgagaggggcctcagagggttggattgtagttggaggcgaatgtccaactgttggtgctgctggtggatttttgcaaggcggtggggtatcttcatggctttcctacgcgcatgggttagcggtggataacgtactagagtacgaagtggtaacagctaaaggagaaattgtgatcgcaaatgcccaccaaaatccagacctattctgggcattgcgtggtggaggcggtggtacatttggcgttgtaacacaagctacattacaagttcaccctgaccttccagtgtctgtcgccgacgccgttgttacgggatctagagctgatgcgacattttggagtcatggcgtggctgcattattgagagcgttacaatttctaaacaatcatggtactgcagggcagtttatccttagaaataccgatgacgatactgtacaagccagtctcacaatgtacttttctaacttgacagttcctgccgtcgccgatgaaaggatggatcctttgagaagagcattagagcataatggccacccttaccaactaacatccagattcctaccacaaatctcttccacttttagacacactgcagacagataccctgaagattatggtattttgatgggatctgttttggtttcattggatttgttcaattcagcaaccggtccagccgctttagctcaacattttgctagactgcctatgacaccagatgacttgctgttcacttctaatctaggcggtagagttagttcacttaacagagatccagcttctacggctatgcacccaggctggagagatgcagctcagttactgaatttcgtaagaggtgtgggtgctccaagtctagccgccaaggctactgcactacatgaacttcaaactgttcagatggcgagattgtacgaaatcgaaccagctttccaaatcagttacagaaaccttggagatccatctgagagaagatcaagagaagtatattggggttctaactatgcccgtttggtcgaggttaaaaggagatgggatccagaaggcttgtttttctccaaactggggattgatggagatgcctgggatgctgaagggatgtgtcgtcaaaccagacagggcgcttggaatgttgcagtcaagtgggttcaatcatttctcggatcattatccgcatctgtagtgtaa

SEQ ID NO: 163 - DNA, 1866 bp, Artificial Sequence
  EasE of A. japonicus codon optimized for S. cerrevisiae Version 2
atgggccagtcgcggggtatcttgggtggcgtccgtcagctcatcctcgtcattctggtgggcgcttatctatctagacttagcgccgtggacgacgaccgtcatgattgccgctgtagacctggcgaaccctgctggccgacagtgtcacattggtccaccttgaatgagtctatcggcggagccctcgcgcacgttaagcccattgcgcacgtctgccaccagtctggccaggacagttccgcttgtgagcaggttctgcaggagtctctggatagcaagtggcgagcctcccacactggggctttgcaggattgggtgtgggaaggaggcgctgagtcgaaccagacttgttactaccttcgatccggccctgctggctcctgccatcagggtcgaatcccattgtacagcgctgcggtcaaaagcgccagcgacgttcagaaggtcgtcgacttcacccgccaacacaacctgcgtctggttattcggaacaccggacacgacggcagtgggcggagcagtggtcccgattcagtcgagattcacacccaccatctaaattctgttcagtaccaccccaacttccgtcccgccggtagctccgaacgccaaagtgcacccggtcagcccgccgttactgtcggtgccggaatcctgctgggtgatctgtacgctcgcggcgcttcggaaggatggatcgttgtgggaggtgagtgccctactgtcggtgctgcgggcggctttctgcaaggcgggggtgtcagctcgtggctttcctacgctcacgggctcgcagttgacaatgtgctggaatatgaggtcgttaccgcgaagggcgagatcgtcatcgctaacgcgcaccaaaatccggatcttttctgggcactccgtggaggtggcggtggtacgtttggtgtggtaacccaggctacactccaagtgcatcctgatctaccagtgtccgtcgctgatgcggtcgtcaccggctcccgtgccgacgcaaccttctggtcgcatggcgtggcagccctcttgcgcgccctgcagtttcttaacaaccacgggactgcgggccagttcatcttacgcaacacggacgatgataccgtccaggcgtccctgacaatgtacttctcgaacctgaccgtaccggcagttgcggacgagcgcatggatccgctgcgtcgtgcactggagcataacggccacccttaccagcttacgagcaggttcctcccccaaattagctccactttccgtcatactgccgacaggtaccccgaggactacggcatcttgatgggcagtgtcctcgtctccttggatttgtttaattctgctaccggtcctgccgctctcgcacagcacttcgcccgcctccccatgacgcctgacgatctccttttcacgtcgaacctgggtggtcgagtgtcgtctctcaaccgggacccagcttccaccgccatgcaccccggttggcgcgatgctgctcaattgcttaacttcgtccggggcgtgggtgccccgagcctcgccgccaaggctaccgccctgcatgagctgcagaccgttcagatggctcgcttgtacgagatcgagccagcgttccagatcagctatcgcaacctcggagacccgtcggagcgtcgctcccgagaggtctactggggttccaactatgcccggctggtcgaagtcaaacgcagatgggaccccgagggactctttttcagtaaacttggcatagacggagatgcctgggacgccgaaggaatgtgccggcagactcgtcaaggtgcttggaacgttgccgtgaagtgggtccaatctttcctcggctccctctctgcctccgtggtgtag

SEQ ID NO: 164 - DNA, 1866 bp, Artificial Sequence
  EasE of A. japonicus codon optimized for S. cerrevisiae Version 3
atgggccagtcccgtggcatcctgggtggcgttcgccagttgatcctcgtgattctggtgggcgcctacctttcccgcctctccgccgtcgacgacgaccgccacgattgccgctgccgtcccggcgagccttgctggcctaccgtctcccactggtccacgctgaacgagagcatcggaggtgccctcgctcatgtcaagcccatcgcacacgtgtgccatcagtcgggccaggactcttccgcttgcgagcaggtgcttcaggagagcctcgacagcaagtggcgagcctctcacacgggcgccctgcaggactgggtctgggagggtggcgccgagtctaaccagacgtgctattatctgcgcagcggtcctgcgggaagctgccaccaaggccgtattcccctgtactctgccgctgtcaagtccgcttccgacgtccagaaagtcgtcgatttcacccgtcagcacaacctccgcctcgtcatccgtaacacgggtcacgatggttctggccgctcgtccggccccgactccgtcgagatccatactcaccatctcaattccgtccagtaccaccctaacttccgtccggcgggtagcagcgaacgtcagtccgctcccggtcagcctgccgtcaccgtcggtgccggcatcctgctgggcgacttgtacgctcgcggagccagcgagggctggattgtggtgggcggtgagtgtcccaccgtgggcgcggccggcggtttccttcaaggcggcggcgtctccagctggctctcttatgctcacggcctggccgtcgacaacgtcctcgaatacgaggtggtcaccgcgaagggtgagatcgtcatcgccaacgctcaccagaaccctgaccttttctgggctctccgtggaggaggcggcggaacctttggcgttgtcacccaggccactctgcaggtccaccccgatttgcccgtgagtgtcgcggacgctgtggttaccggctcgcgcgcagacgccaccttctggagccacggtgtcgctgccctcttgcgcgctttgcagttcctcaacaaccacggcactgcgggtcagttcatcctgcgtaacactgatgacgatacagtccaggcctctctgaccatgtacttctccaacctcaccgtccccgccgtggccgacgagcgcatggaccccctccgccgtgctctggagcacaacggacacccctaccaattgactagccgcttcctgccccaaatttcctccactttccggcacaccgccgaccgctaccccgaggactacggcatcctgatgggatcggtcctcgtctccttggatctgttcaactcggccaccggcccggccgctctggcccagcacttcgcccgccttcctatgacccccgacgacctgctgtttacttccaatctgggcggtcgcgtcagcagcctcaatcgggatccagccagtaccgccatgcaccccggctggcgcgacgctgcacagcttctgaacttcgtccggggtgttggcgccccctccctcgccgcgaaggccaccgccctgcatgagttgcagaccgttcagatggctcggctctacgagatcgagcctgccttccaaatctcgtaccgtaacctgggtgacccgtccgagcgccgttcccgtgaagtctactggggctccaactacgcccgcctcgttgaagtgaagcggcgctgggacccggagggtctgtttttctccaagctcggcatcgacggtgatgcctgggacgctgagggtatgtgtcggcagacccgtcagggcgcctggaacgtcgctgttaagtgggtgcagtccttcctgggtagcctgtctgcttctgttgtgtag

SEQ ID NO: 165 - DNA, 1866 bp, Artificial Sequence
  EasE of A. japonicus codon optimized for S. cerrevisiae Version 4
atgggtcaatcccgaggtattctcggtggtgttagacaattgatcttggttattttggttggtgcctacttgtctagattgtctgctgttgatgatgatagacatgattgcagatgtagaccaggtgaaccatgttggccaactgtttctcattggtctactttgaacgaatctattggtggtgctttggctcatgttaagccaattgctcatgtttgtcatcaatccggtcaagattcttctgcttgcgaacaagttttacaagaatccttggattctaagtggcgtgcttctcatactggtgctttacaagattgggtttgggaaggtggtgctgaatctaatcaaacttgttactacttgagatcaggtccagctggttcttgtcatcaaggtagaattccattatattccgctgctgttaagtccgcttctgatgttcaaaaggttgttgatttcaccagacaacacaacttgagattggttattagaaacaccggtcatgatggttctggtagatcatctggtccagattctgttgaaattcatacccatcacttgaactccgttcaataccatccaaattttagaccagctggttcctctgaaagacaatctgctccaggtcaaccagctgttactgttggtgctggtattttgttgggtgacttgtatgctagaggtgcttctgaaggttggatagttgttggtggtgaatgtccaacagttggtgctgctggtggttttttacaaggtggtggtgtttcttcttggttgtcttatgctcatggtctcgcggttgataacgtcctcgaatacgaagttgttactgctaagggtgaaatcgttattgctaacgctcatcaaaacccagatttgttttgggctttgagaggcggtggtggtggtacttttggtgttgttactcaagctacattgcaagttcatccagatttgccagtttctgttgctgatgctgttgttactggttctagagctgatgctactttttggtcacatggtgttgctgctttgttgagagctttacaattcttgaacaaccatggtactgccggtcaattcattttgagaaacactgatgatgataccgtccaagctagtttgactatgtacttctctaacttgactgttccagctgttgctgacgaaagaatggatcctttgagaagagctttggaacataatggtcatccataccaattgacctctagattcttgccacaaatctcttctactttcagacataccgctgatagatacccagaagattacggtattttgatgggttccgttttggtttccttggacttgtttaattctgctactggtccagctgctttggcacaacattttgctagattgccaatgactccagatgatttgttgttcacttctaacttgggtggtagagtctcttcattgaatagagatccagcttctactgcgatgcatccaggttggagagatgctgctcaattattgaatttcgttagaggtgttggtgctccatctttggctgctaaagcgactgcgttacatgaattgcaaaccgttcaaatggccagattatacgaaattgaaccagccttccaaatctcctacagaaatttgggtgatccatccgaaagaagatccagagaagtttattggggttctaactacgctagattggttgaagttaagagaagatgggatccagaaggtttgttcttctccaaattgggtattgatggtgatgcttgggatgctgaaggtatgtgtagacaaacaagacaaggtgcttggaatgttgctgttaagtgggttcaatctttcttgggttctttgtctgcttccgttgtttga

SEQ ID NO: 166 - DNA, 1569 bp, Saccharomyces cerevisiae
atgaagttttctgctggtgccgtcctgtcatggtcctccctgctgctcgcctcctctgttttcgcccaacaagaggctgtggcccctgaagactccgctgtcgttaagttggccaccgactccttcaatgagtacattcagtcgcacgacttggtgcttgcggagttttttgctccatggtgtggccactgtaagaacatggctcctgaatacgttaaagccgccgagactttagttgagaaaaacattaccttggcccagatcgactgtactgaaaaccaggatctgtgtatggaacacaacattccagggttcccaagcttgaagattttcaaaaacagcgatgttaacaactcgatcgattacgagggacctagaactgccgaggccattgtccaattcatgatcaagcaaagccaaccggctgtcgccgttgttgctgatctaccagcttaccttgctaacgagacttttgtcactccagttatcgtccaatccggtaagattgacgccgacttcaacgccaccttttactccatggccaacaaacacttcaacgactacgactttgtctccgctgaaaacgcagacgatgatttcaagctttctatttacttgccctccgccatggacgagcctgtagtatacaacggtaagaaagccgatatcgctgacgctgatgtttttgaaaaatggttgcaagtggaagccttgccctactttggtgaaatcgacggttccgttttcgcccaatacgtcgaaagcggtttgcctttgggttacttattctacaatgacgaggaagaattggaagaatacaagcctctctttaccgagttggccaaaaagaacagaggtctaatgaactttgttagcatcgatgccagaaaattcggcagacacgccggcaacttgaacatgaaggaacaattccctctatttgccatccacgacatgactgaagacttgaagtacggtttgcctcaactctctgaagaggcgtttgacgaattgagcgacaagatcgtgttggagtctaaggctattgaatctttggttaaggacttcttgaaaggtgatgcctccccaatcgtgaagtcccaagagatcttcgagaaccaagattcctctgtcttccaattggtcggtaagaaccatgacgaaatcgtcaacgacccaaagaaggacgttcttgttttgtactatgccccatggtgtggtcactgtaagagattggccccaacttaccaagaactagctgatacctacgccaacgccacatccgacgttttgattgctaaactagaccacactgaaaacgatgtcagaggcgtcgtaattgaaggttacccaacaatcgtcttatacccaggtggtaagaagtccgaatctgttgtgtaccaaggttcaagatccttggactctttattcgacttcatcaaggaaaacggtcacttcgacgtcgacggtaaggccttgtacgaagaagcccaggaaaaagctgctgaggaagccgatgctgacgctgaattggctgacgaagaagatgccattcacgatgaattgtaa

SEQ ID NO: 167 - DNA, 921 bp, Saccharomyces cerevisiae
atgcagttgagcaaggctgctgagatgtgttatgagataacaaactcttacttacacatagaccagaaatctcagataatagcaagtacacaagaagcgatacggttgacaagaaaatacttactaagtgaaatttttgtacgttggagtccactgaatggggaaatatcattctcgtacaacggaggaaaagattgccaggtattactactgttatatctgagttgcttatgggaatatttcttcattaaggctcaaaattcccaattcgatttcgagtttcaaagcttccccatgcaaagacttccaactgttttcattgatcaagaagaaactttccctacattagagaattttgtactggaaacctcagagcgatattgcctttccttatacgaatcacaaaggcaatctggtgcatcggtcaatatggcagacgcatttagagattttataaagatataccctgagaccgaagctatagtgataggtattagacacacagacccatttggtgaagcattaaagcctattcaaagaacagattctaactggcctgattttatgaggttgcaacctctcttacactgggacttaaccaatatatggagtttcttactgtattctaatgagccaatttgtggactatatggtaaaggtttcacatcaatcggcggaattaacaactcattgcctaacccacacttgagaaaggactccaataatccagccttgcattttgaatgggaaatcattcatgcatttggcaaggacgcagaaggcgaacgtagttccgctataaacacgtcacctatttccgtggtggataaggaaagattcagcaaataccatgacaattactatcctggctggtatttggttgatgacactttagagagagcaggcaggatcaagaattaa

SEQ ID NO: 168 - DNA, 1997 bp, Artificial Sequence
  P/T cassette including both AscI sites
ggcgcgccatgcagggatatcagatctaatgctactattttggagatcaatctcagtacaaaacaatattaaaaagaggtgaattatttttccccccttattttttttttgttagaattgatccaaatgtaaataaacaatcacaaggaaaaaaaaaaaaaaaaaaaatagccgccatgaccccggatcgtcggttgtgatacggtcagggtagcgccctggtcaaacttcagaactaaaaaaataataaggaagaaaaaaatagctaatttttccggcagaaagattttcgctacccgaaagtttttccggcaagctaaatggaaaaaggaaagattattgaaagagaaagaaagaaaaaaaaaaaatgtacacccagacatcgggcttccacaatttcggctctattgttttccatctctcgcaacggcgggattcctctatggcgtgtgatgtctgtatctgttacttaatccagaaactggcacttgacccaactctgccacgtgggtcgttttgccatcgacagattgggagattttcatagtagaattcagcatgatagctacgtaaatgtgttccgcaccgtcacaaagtgttttctactgttctttcttctttcgttcattcagttgagttgagtgagtgctttgttcaatggatcttagctaaatgcatattttttctcttggtaaatgaatgcttgtgatgtcttccaagtgatttcctttccttcccatatgatgctaggtacctttagtgtcttcctaaaaaaaaaaaaaggctcgccatcaaaacgatattcgttggcttttttttctgaattataaatactctttggtaacttttcatttccaagaacctcttttttccagttatatcatggtcccctttcaaagttattctctactctttttcatattcattctttttcatcctttggttttttattcttaacttgtttattattctctcttgtttctatttacaagacaccaatcaaaacaaataaaacatcatcacaaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagcatgcccatgggttaactgatcaatgcatcctgcatggcgcgcc

SEQ ID NO: 169 - DNA, 9612 bp, Artificial Sequence
  Integration vector pEVE2658
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccctgcaggctgcaacttgtcagcctttgcgacgatttgtaatgaatccttttgcatcgctagaaggagaagataatatttcttctgttttttttttacatatgcaacaatttgaaagtcaggtcaaagacagattccggttccccatattcagataggagaaaaaaacttttggcaactcatgttaccaagtcgagaccttaaagttaagtgtcggcctggaaacgcaaaatcttgtaatcttttaacgctgcttttcaaatcacgaacgcaatcagtacttgtacctaattttggttttctcgtattgaatagtgaaccataggtcgaaaatttaaggccacataaatccagagcccgcaacttggataggtatttacttgatttttagtttgctttcaatagtgtcgtgaaattataaagtacgccgcatacatatcttgattagttaaaaatagcagtgttcaatgatgatttgatagggttcataactggtaccagcgtagtacaattacgattatccatgaacataaaagtggcttaaatactatatatcagtgaagcttcaaagtaagcaaacgagataccaagatcttgtaggaccacgatatataagaagcctagttccgttgtagcatcacatagaagagagcgacgatgcctcagaaagtctacagcaacagaaagctcagtgagcggccgccagctgaagcttcgtacgctgcaggtcgacaacccttaatataacttcgtataatgtatgctatacgaagttattaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtatgaccgaccaagcgacgcccaacctgccatcacgagatttcgatcccaccgccgccttctatgaaaggttgggcttcggaatcgttttccgggacgccggctggatgatcctccagcgcggggatctcatgctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggcgcgcctttgaaactaaatttgtatattgtttgtcagaaataggacctgatatcctccttttaaacagttgatgagaacctttttcgcaagttcaaggtgctctaatttttaaaatttttacttttcgcgacacaataaagtcttcacgacgctaaactattagtgcacataatgtagttacttggacgctgttcaataatgtataaaatttatttcctttgcattacgtacattatataaccaaatcttaaaaatatagaaatatgatatgtgtataataatataagcaaaatttacgtatctttgcttataatatagctttaatgttctttaggtatatatttaagagcgatttgtccgcggttacaattcatcgtgaatggcatcttcttcgtcagccaattcagcgtcagcatcggcttcctcagcagctttttcctgggcttcttcgtacaaggccttaccgtcgacgtcgaagtgaccgttttccttgatgaagtcgaataaagagtccaaggatcttgaaccttggtacacaacagattcggacttcttaccacctgggtataagacgattgttgggtaaccttcaattacgacgcctctgacatcgttttcagtgtggtctagtttagcaatcaaaacgtcggatgtggcgttggcgtaggtatcagctagttcttggtaagttggggccaatctcttacagtgaccacaccatggggcatagtacaaaacaagaacgtccttctttgggtcgttgacgatttcgtcatggttcttaccgaccaattggaagacagaggaatcttggttctcgaagatctcttgggacttcacgattggggaggcatcacctttcaagaagtccttaaccaaagattcaatagccttagactccaacacgatcttgtcgctcaattcgtcaaacgcctcttcagagagttgaggcaaaccgtacttcaagtcttcagtcatgtcgtggatggcaaatagagggaattgttccttcatgttcaagttgccggcgtgtctgccgaattttctggcatcgatgctaacaaagttcattagacctctgttctttttggccaactcggtaaagagaggcttgtattcttccaattcttcctcgtcattgtagaataagtaacccaaaggcaaaccgctttcgacgtattgggcgaaaacggaaccgtcgatttcaccaaagtagggcaaggcttccacttgcaaccatttttcaaaaacatcagcgtcagcgatatcggctttcttaccgttgtatactacaggctcgtccatggcggagggcaagtaaatagaaagcttgaaatcatcgtctgcgttttcagcggagacaaagtcgtagtcgttgaagtgtttgttggccatggagtaaaaggtggcgttgaagtcggcgtcaatcttaccggattggacgataactggagtgacaaaagtctcgttagcaaggtaagctggtagatcagcaacaacggcgacagccggttggctttgcttgatcatgaattggacaatggcctcggcagttctaggtccctcgtaatcgatcgagttgttaacatcgctgtttttgaaaatcttcaagcttgggaaccctggaatgttgtgttccatacacagatcctggttttcagtacagtcgatctgggccaaggtaatgtttttctcaactaaagtctcggcggctttaacgtattcaggagccatgttcttacagtggccacaccatggagcaaaaaactccgcaagcaccaagtcgtgcgactgaatgtactcattgaaggagtcggtggccaacttaacgacagcggagtcttcaggggccacagcctcttgttgggcgaaaacagaggaggcgagcagcagggaggaccatgacaggacggcaccagcagaaaacttcattttaagcttgtttagttaattatagttcgttgaccgtatattctaaaaacaagtactccttaaaaaaaaaccttgaagggaataaacaagtagaatagatagagagaaaaatagaaaatgcaagagaatttatatattagaaagagagaaagaaaaatggaaaaaaaaaaataggaaaagccagaaatagcactagaaggagcgacaccagaaaagaaggtgatggaaccaatttagctatatatagttaactaccggctcgatcatctctgcctccagcatagtcgaagaagaattttttttttcttgaggcttctgtcagcaactcgtattttttctttcttttttggtgagcctaaaaagttcccacgttctcttgtacgacgccgtcacaaacaaccttatgggtaatttgtcgcggtctgggtgtataaatgtgtgggtgcaacatgaatgtacggaggtagtttgctgattggcggtctatagataccttggttatggcgccctcacagccggcaggggaagcgcctacgcttgacatctactatatgtaagtatacggcccacgcgcccagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacggacacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaaagcttaaaatgcagttgagcaaggctgctgagatgtgttatgagataacaaactcttacttacacatagaccagaaatctcagataatagcaagtacacaagaagcgatacggttgacaagaaaatacttactaagtgaaatttttgtacgttggagtccactgaatggggaaatatcattctcgtacaacggaggaaaagattgccaggtattactactgttatatctgagttgcttatgggaatatttcttcattaaggctcaaaattcccaattcgatttcgagtttcaaagcttccccatgcaaagacttccaactgttttcattgatcaagaagaaactttccctacattagagaattttgtactggaaacctcagagcgatattgcctttccttatacgaatcacaaaggcaatctggtgcatcggtcaatatggcagacgcatttagagattttataaagatataccctgagaccgaagctatagtgataggtattagacacacagacccatttggtgaagcattaaagcctattcaaagaacagattctaactggcctgattttatgaggttgcaacctctcttacactgggacttaaccaatatatggagtttcttactgtattctaatgagccaatttgtggactatatggtaaaggtttcacatcaatcggcggaattaacaactcattgcctaacccacacttgagaaaggactccaataatccagccttgcattttgaatgggaaatcattcatgcatttggcaaggacgcagaaggcgaacgtagttccgctataaacacgtcacctatttccgtggtggataaggaaagattcagcaaataccatgacaattactatcctggctggtatttggttgatgacactttagagagagcaggcaggatcaagaattaaccgcggcacgtccgacggcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgccgcgagggcacatacatacagtgggacctcatgagatccagaaaaaaagcaaaggaaagttcgatcgaaacattagctcttagatattacagacgtgaggtatctcttccttgaagagaatctggccctgatcaaaaactttattttgatactgttcgaaaagagaaataaggacaacgttctaatttatacaaatataaccagtaggctttatcgtaaaatcctcgaacttgcttctcatcacagaagtataaaaagtaaagaggtcaagcaagaaacgaataaccaccaaatttttttcaattgaaaagcgaaacgtaatggaaattcacctgctttgaatcgttgttgaattcttatcatcagtcattattttcctcttttaaagcttaagtcaaccgcatctaagtttaacacttcgttcccgttttgaagtttatcaaaattccaaaatacagtagttaggtgctcgtgacaaacctttttccaaagtgtcattagacttcatggaactactacacttctggggaacgaaaagctaccatttgctcatcattggataatttctttttttttttttgatgcatccaaacttggaccccttttgaatgtcgagtatgaagtatcaattttagggcaagtagttttacaataattttggtgcacttttacgcctctgctgacctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 170 - DNA, 10201 bp, Artificial Sequence
  Integration vector pEVE2682
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccctgcaggtcaatcaaagcaacccacaaatcctaggctgaatcatgatatcgatggaagcaatcaacaattttatcaagaccgcaccaaagcacgactatctgacaggcggagttcatcattctggtaatgtagacgtgttacaattaagcggcaataaagaagatggtagtttagtatggaaccatacttttgttgatgtagacaacaatgtggtagctaagtttgaagacgctctcgaaaaacttgaaagtttgcaccggcgctcatcctcatccacaggcaatgaagaacacgctaacgtttaaccgaggggagtcacttcataatgatgtgagaaataagtgaatattgtaataattgttgggactccattgtcaacaaaagctataatgtaggtatacagtatatactagaagttctcctcgaggatcttggaatccacaaaagggagtcgataaatctatataataaaaattactttatcttctttcgttttatacgttgtcgtttattatcctattacgttatcaatcttcgcatttcagctttcattagatttgatgactgtttctcaaactttatgtcattttcttacccgcagcggccgccagctgaagcttcgtacgctgcaggtcgacaacccttaatataacttcgtataatgtatgctatacgaagttattaggtctagagatctgtttagcttgccttgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggcgcgccgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcggctagtactgggtgatgacgccaggctctgatccatctggggttagtggtagttttgtctccctaacggtggttccggcggtcttggtcagcttggacagctcttggacggtggctgaaaggccagggtccacatggacagagttgaaggatgaggtaacccaatcaccagtttccaaagattgcaagtagacggacaagtatggcttgttctttctgtaagagaatgagatgtaagcgtgcaagtagttcaaagtttcgtgatcagcatgtgggtaatgagagcacaattcagctttgtactgtctagccatttcgtgccaaccacgacgttcgaagaaagtagccaaagcatcagcaatttgcatgtcgtttctaccgaaagtagtaaagtaaacttgtggttctggaactggatcatcatgatggatggtgtagttggccatcaatggcaattgttcatctggaatagtaccgattggcaaatatggagctggataagattgtaaaccagctggcaatctgatcaattcccacaattctctaatcatttccaaaccagccaaagtagaagcatcagttctttcaccacccatagtccacaaatcttccaaggcttccaaagtgaccattctttccaacaagtagattttgattctggacttggtagggtcaatcaaatcgcaagacaataatcttggagaggcagtagaagatggacctctagaataaacgtattgttccaaggtatccaatggctttctcaattctgggtattgcttagaccatctgaaagcagaaccaaaaaccaattcgtggatacttctaccagtagccaaagatttcaaggctgggtagatgtaagtcttaacaacgaattcaccatcttgcaagtccaaagccaatttgttttgggttctgatttgttcaccgaccaagttgttcttgtacaagtattcggattcttcagcagacaaagtcaagtcgttcttgaagtgtctgaacaaatccaaatcgataccggattgtaaagccatcaattgttccaatgagtcccaaacagcatgagtattgaatggatctctagcagtaccagtagcagcgttaataggttcgtaagtgtatctaaccaatggaccagaacagttcaaagacaattcgaatggagtaccatatctggtcaaaatggacaaccatcttggcttatcattagttgggtaaacacccaagaatggaatgacgttcttcttgtagatcaacaagtgcttgtactgagcgtgtaagttgtagttggtagattgcaacatttgagcaaacattggagcagtagaatgccaccacaattcttcatcttgattggcgaaatccaaagcaacagacaaagttctgtagacttcgcaatcagaagcattaccagtcttaataccttgaccagcagtcattttaagctttgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattatgcagatgttataatatctgtgcgtacgcgcccagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacggacacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaaagcttaaaatgaccattaccgaaacttctaagccaaccttgagaagaattccaagatcagctggtgatgaagctattttccaagtcttgcaagaagatggcgttgttgttatcgaaggtttcatgtctgctgaccaagttagaagattcaacggtgaaattgatccacacatgaagcaatgggaattgggtcaaaaatcctaccaagaatcttacttggctggtatgagacaattgtcatctttgcctttgttctccaagttgttcagagatgaattgatgaacgacgaattattgcacggtttgtgcaagagattattcggtccagaatctggtgattactggttgactacttcttctgttttggaaactgaaccaggttaccatggtcaagaattgcatagagaacatgatggtattccaatctgtactaccttgggtagacaatctccagaatctatgttgaacttcttgactgctttgactgatttcactgctgaaaatggtgctactagagttttgccaggttctcatttgtgggaagatttttctgctccaccaccaaaagctgatactgctattccagctgttatgaatccaggtgatgctgttttgtttactggtaaaactttacatggtgccggtaagaacaacactactgattttttgagaagaggtttcccattgatcatgcaatcttgtcaattcactccagttgaagctagtgttgctttgccaagagaattggttgaaactatgactccattggcccaaaaaatggttggttggagaactgtttctgctaagggtgttgatatttggacctacgatttgaaggatttggctaccggtattgacttgaagtctaatcaagttgctaagaaggcctaaccgcggcacgtccgacggcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgcccatggaaaatgcaaccgataaaccattataaatcttcgcggttatctggcattgttattaaccaaaaaaatgccggcctattacaagctactgttcaataaatattgttgtaatgaagacggtccaactgtacaaatacagcaaactgtcatatataaggagtcttatgtgacagcacttgcgttattgtcagccggagtatgtctttgtcgcattctgggctttttactttctgctcagaaggaagtacgaacaagaaaaaaaaatcaccaatgcttcccttttcagtattagtttcatatttgtttacgttcaaactcgtcgtttgcgcgataacctctaaaaaagtcaattacgtaactatatcaatcagagaatgcaaaaagcactatcataaaaatgtgtctaggggatgtgagacatgtcaattataagaagtgatggtgtcatagtatatatatcataaaagattatcaaagtttcaatcctttgtattttctagtttagcgccaacttttgacaaaacctaaactttagataatcatcattcttacaatttttatctggatggcaataatctcctatataaagcccagataaactgtaaaaagaatccatcactatttgaaaaaaagtcatctggcacgtttaattatcagagcagaaatgatgaagggtgttagcgccgtccactgatgtgcctggtagtcatgatttacgtataactaacacatcatgaggacggccctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 171 - DNA, 12651 bp, Artificial Sequence
  Integration vector pEVE2723
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccctgcaggttcgtgaaacacgtgggataccggttaggtaatattacagtttccttacacacttactaaatacgcaacagagcatgttattaatcgtatatttaagtaataataacgtattgaccattcctaagactgaagcagtaccaagaaatggcactttttgtttatatgacatagtaaaagtgttcatttggcagaaaacaagggtatctggatactgcaatcctcattagttgcggagagcttttttaaagttttattacttcgataatgctttcctccagaactgggcgcgcactgaagccataaactgagtggttgtccctgtgtatattctacaatcgcctatttgaaacttctgggtgataatatcgatttagcgattgggtttctcccttctgagattctggataaatgagatgctaccctcacagtaaaaacagtacaaaacctttgtatagttctagtcaaatatgaactccttcattcatggattgtatactattgttcttgttgaaagattcctcttgtgattttcatggtgattttaagccttttttattgaaagaattaaatattcactaggctgcgatacgatagacaaacgaagtgattgaaacccgaattaacggagcggccgccagctgaagcttcgtacgctgcaggtcgacaacccttaatataacttcgtataatgtatgctatacgaagttattaggtctagagatctgtttagcttgccttgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgacggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtggcctatgcggccgcggcgcgccatgcagggatatcagatctgggccgtatacttacatatagtagatgtcaagcgtaggcgcttcccctgccggctgtgagggcgccataaccaaggtatctatagaccgccaatcagcaaactacctccgtacattcatgttgcacccacacatttatacacccagaccgcgacaaattacccataaggttgtttgtgacggcgtcgtacaagagaacgtgggaactttttaggctcaccaaaaaagaaagaaaaaatacgagttgctgacagaagcctcaagaaaaaaaaaattcttcttcgactatgctggaggcagagatgatcgagccggtagttaactatatatagctaaattggttccatcaccttcttttctggtgtcgctccttctagtgctatttctggcttttcctatttttttttttccatttttctttctctctttctaatatataaattctcttgcattttctatttttctctctatctattctacttgtttattcccttcaaggtttttttttaaggagtacttgtttttagaatatacggtcaacgaactataattaactaaacaagcttaaaatgggtcaatccagaggtattttgggtggtgttagacaattgatcttggttattttggttggtgcctacttgtctagattgtctgctgttgatgatgatagacatgattgcagatgtagaccaggtgaaccatgttggccaactgtttctcattggtctactttgaacgaatctattggtggtgctttggctcatgttaagccaattgctcatgtttgtcatcaatccggtcaagattcttctgcttgcgaacaagttttacaagaatccttggattctaagtggcgtgcttctcatactggtgctttacaagattgggtttgggaaggtggtgctgaatctaatcaaacttgttactacttgagatcaggtccagctggttcttgtcatcaaggtagaattccattatattccgctgctgttaagtccgcttctgatgttcaaaaggttgttgatttcaccagacaacacaacttgagattggttattagaaacaccggtcatgatggttctggtagatcatctggtccagattctgttgaaattcatacccatcacttgaactccgttcaataccatccaaattttagaccagctggttcctctgaaagacaatctgctccaggtcaaccagctgttactgttggtgctggtattttgttgggtgacttgtatgctagaggtgcttctgaaggttggatagttgttggtggtgaatgtccaacagttggtgctgctggtggttttttacaaggtggtggtgtttcttcttggttgtcttatgctcatggtttggctgttgataacgtcttggaatacgaagttgttactgctaagggtgaaatcgttattgctaacgctcatcaaaacccagatttgttttgggctttgagaggcggtggtggtggtacttttggtgttgttactcaagctacattgcaagttcatccagatttgccagtttctgttgctgatgctgttgttactggttctagagctgatgctactttttggtcacatggtgttgctgctttgttgagagctttacaattcttgaacaaccatggtactgccggtcaattcattttgagaaacactgatgatgataccgtccaagctagtttgactatgtacttctctaacttgactgttccagctgttgctgacgaaagaatggatcctttgagaagagctttggaacataatggtcatccataccaattgacctctagattcttgccacaaatctcttctactttcagacataccgctgatagatacccagaagattacggtattttgatgggttccgttttggtttccttggacttgtttaattctgctactggtccagctgctttggcacaacattttgctagattgccaatgactccagatgatttgttgttcacttctaacttgggtggtagagtctcttcattgaatagagatccagcttctactgctatgcatccaggttggagagatgctgctcaattattgaatttcgttagaggtgttggtgctccatctttggctgctaaagctactgctttacatgaattgcaaaccgttcaaatggccagattatacgaaattgaaccagccttccaaatctcctacagaaatttgggtgatccatccgaaagaagatccagagaagtttattggggttctaactacgctagattggttgaagttaagagaagatgggatccagaaggtttgttcttctccaaattgggtattgatggtgatgcttgggatgctgaaggtatgtgtagacaaacaagacaaggtgcttggaatgttgctgttaagtgggttcaatctttcttgggttctttgtctgcttccgttgtttgaccgcggacaaatcgctcttaaatatatacctaaagaacattaaagctatattataagcaaagatacgtaaattttgcttatattattatacacatatcatatttctatatttttaagatttggttatataatgtacgtaatgcaaaggaaataaattttatacattattgaacagcgtccaagtaactacattatgtgcactaatagtttagcgtcgtgaagactttattgtgtcgcgaaaagtaaaaattttaaaaattagagcaccttgaacttgcgaaaaaggttctcatcaactgtttaaaaggaggatatcaggtcctatttctgacaaacaatatacaaatttagtttcaaagcatgcccatgggttaactgatcaatgcatcctgcatggcgcgccgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcggtcacaatctagctggaataaaagattcttcagctggagcttcagacttttgcaacaaggtttcaacacctttttgaattctagcagccaaagctggagaaaccaacttccaggtttcgtaaacttgcttttgaatttcggctctggtttgagcaacagattcaaccatgttttggaccatggtatcttggaattcttgacctctaaaatctggcaaaacttcgtagaaatctctggcgaacttgtaatcatgttcagtagtttgcaaccaggacttggattggatttctttcaaccattcattatactttggatctggttctctaggttcggcaaatctaactggttgttgttgagtcaagaaacctggatgagcaccataattagcatcaaaagtaccttgaccatctctagcaattgggttaaaggtatgagcggatctattaactgggatttgttgatggttagcacccaatctatatctttgagcgtctgggtaagcgaaaattctagcttgtaaaattggatcttcagatggagcaacacctggaaccatgttagatggagagtaagccaattgttcaatttcggcgaagtagttagctgggtttcttttcaaagtcaacttaccgaaaacctttggtgggatcaaagtaacatcttttgggtaagtacccaagttccagtgcttagtaacatccaaaatgttgtaacccaagtttggagcatcttttggatcaacaacttgaacagaagcagtccaagttgggtattcacctctttcaatagcttcatacaagtctctagtagcgtgatctggatccaaatcatttgtacctttagcttgttgaccatcggtgaaatttggacctctatcagatgacaagaagatgtggacgtacttaaaagaaccatctggcttaacccatttgtaagcatgagccatataaccagacatggatctccaattgaacatagtaccgaaatcagaaaattgcaacaagaccatgtgcaaggattcatgattgttggtaacccaatcccagtacatgtttgggttcaacaaattagtttgtggatctcttctttgagcgtgcatcaaagatgggaacttgactggatcacgaatgaagaagaatgggaaattcaacatgacccaatcccaattaccttcagtagtgtagaacttacaagccatacctttcaaatctctcataccttcgttagaacctctttccaaaccagtggtagagaatctagtaacacatggagtctttttaccgacaccaaccaacatatcgatatcgcaaatatcggagatatcggcagtaacttcaaattcaccataagcaccagcacctttagcgtgaacaactctttctggaatcttttctctgttgaaatgggccaaggtatcaaccaaatgatgatcagacaaagccaaagttctaccatcagctggtggaccttcaggcttatgaaatggacaaccattagcagtagtgtaagttggcttagaatctggagccattttaagctttgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattatgcagatgttataatatctgtgcgtacgcgcccagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacggacacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaaaagcttaaaatgaccattaccgaaacttctaagccaaccttgagaagaattccaagatcagctggtgatgaagctattttccaagtcttgcaagaagatggcgttgttgttatcgaaggtttcatgtctgctgaccaagttagaagattcaacggtgaaattgatccacacatgaagcaatgggaattgggtcaaaaatcctaccaagaatcttacttggctggtatgagacaattgtcatctttgcctttgttctccaagttgttcagagatgaattgatgaacgacgaattattgcacggtttgtgcaagagattattcggtccagaatctggtgattactggttgactacttcttctgttttggaaactgaaccaggttaccatggtcaagaattgcatagagaacatgatggtattccaatctgtactaccttgggtagacaatctccagaatctatgttgaacttcttgactgctttgactgatttcactgctgaaaatggtgctactagagttttgccaggttctcatttgtgggaagatttttctgctccaccaccaaaagctgatactgctattccagctgttatgaatccaggtgatgctgttttgtttactggtaaaactttacatggtgccggtaagaacaacactactgattttttgagaagaggtttcccattgatcatgcaatcttgtcaattcactccagttgaagctagtgttgctttgccaagagaattggttgaaactatgactccattggcccaaaaaatggttggttggagaactgtttctgctaagggtgttgatatttggacctacgatttgaaggatttggctaccggtattgacttgaagtctaatcaagttgctaagaaggcctaaccgcggcacgtccgacggcggcccgacgggtccgaggcctcggagatccgtcccccttttcctttgtcgatatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgcctgcctacgcaacactttagctgctttttttaagcagcggcagatgaggatttaaataacgcataaccaagaatatacctaatgaagtgaaggtatacaggctgttctatggacttgaataatactggctaccctggcgtcctaatgtcgttaagaaagtaacttgatatcagattaatcacaaacttggtccacaaaataccacttatctcatataatctaaatctgactaaagggtgtaggcacggaacttcggacctagaggtattgctcaatatgtatatttctcaatggttcatctaggtaagcaaggccttgaataatatacttaatcttgtctgtttcgcaacaattgctgagtacaataatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattatagccttaatcacaatggaatcccaacaacctgcagggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 172 - DNA, 1850 bp, Artificial Sequence
  PF cassette including both AscI sites
ggcgcgccatgcagggatatcagatctatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatctatcaaaaagcttggcctgcagggccagcttacccttaaatttatttgcactactggaaaactacctgttccatggccaacacttgtcactactttctcttatggtgttcaatgcttttcccgttatccggatcatatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattacacatggcatggatgagctctacaaataatgaattcgtcgaggccgttcaggcctcgaggccgttcaggctcgacccggggatccgcggttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagcatgcccatgggttaactgatcaatgcatcctgcatggcgcgcc

SEQ ID NO: 173 - DNA, 15212 bp, Artificial Sequence
  HRT1 containing DmaW, EasF, EasC, and EasE
accacggtgaacaatccccgctggctcatatttgccgccggttcccgtaaatcctccggtacgctccagcgtgttttatctctgcgagcataatgcctgcgtcatccgccagcaggagctggactttactgatgcccgttatatctgcgaaaagaccgggatctggacccgtgatggcattctctggttttcgtcatccggtgaagagattgagccacctgacagtgtgacctttcacatctggacagcgtacagcccgttcaccacctgggtgcagattgtcaaagactggatgaaaacgaaaggggatacgggaaaacgtaaaaccttcgtaaacaccacgctcggtgagacgtgggaggcgaaaattggcgaacgtccggatgctgaagtgatggcagagcggaaagagcattattcagcgcccgttcctgaccgtgtggcttacctgaccgccggtatcgactcccagctggaccgctacgaaatgcgcgtatggggatgggggccgggtgaggaaagctggctgattgaccggcagattattatgggccgccacgacgatgaacagacgctgctgcgtgtggatgaggccatcaataaaacctatacccgccggaatggtgcagaaatgtcgatatcccgtatctgctgggatactggcgttttcccgtctttcagtgccttgttcagttcttcctgacgggcggtatatttctccagcttacgcgccatgcagggatatcagatcttcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgagcatgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaacggcgcgttcatcgtccacctccggagaacaggccaccatcacgcatctgtgtctgaatttcatcacgacgcgccttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtattggaccaccctgtgggtttataagcgcgctgctggcgtgtaaggcggtgacggcgaaggaagggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacggcgcgtggcacccttgcgggccatgtcatacaccgccttcagagcagccggacctatctgcccgttacgcgccagcttgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaagggggacggatctccgaggcctcggacccgtcgggccgccgtcggacgtgccgcggttatggagttgcagcaccaacgttaatattggcaccgtaaactggtctagaatcttcagacaacaaccagacgatagttctagcaacatcttcaggttgaatgattgggaaaccttctttgatgtaggcttcttttacttcgtcgatagatttagcttgtggcatgaattgtggcaaagctggagtatcggtaatacctggagaaacagaattgattctaatacccaatggccaagcatccatagcagcacaagaagtaaagtaagcacaagcacctttagaagtaccgtaagcataagcatctggcaaatggataaaggcagcaatggaaccaatgttaacgatagctctatcttttggacctggcaaagccttcatagctctaataccagctctagtacagtagaaaacaccgtccaagttaaccttgaaaactctttgccattcttcatcagtttcttccaacaaagctggagcttgtctagcaccagctggttgagcaataccagcaacattagccaaaccatgcaagtcaccaaaagtttgaacgatagtttgcaaccaagcatcaacttcagcggatgaagaaacatccaatctagtgcaatgaacctttgtagctggattcaaggcttgaatatcagaggtaacggattcgaaaccctttggagaaatatcaccaatgcatataacagcagcacctctagcagccaataatctacaagtagcagcaccaataccagaagcaccaccagtaacagcgaaaattctagagttgacaacggtcataagctttttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgtccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgggcgcgtcgtgccgtcgttgttaatcaccacatggttattctgctcaaacgtcccggacgcctgcgaacgcgccgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcggttatggactttttctgttcctctaacgcttccaacaggaggataaccttatccatactggcagaacccatatcgattactaagctatcttgagcgattgaagcagccatcttactagcttcagctttgaggatgcatagttcctcatgtctaggatagaaatcagcagcgtgggaatgtctattccaatgctgaatgccttttgttgagtaaaacaaaagtgcaggaagtgtcttgacttccttagttagaccttcgacaacttggtctggtatagaactttccaaccctgcttgtctaatatcaataataggtggagcagaaattgtcatttagttcaatcttagtctcaattgatagaatgctacgtcacagtctggtgctgtccacactgcggcatcctccaaacccgctgaatgaaacaactgatccctttcagctttgtcgtatttgtaagagcatccaaatctgatcttttcatcacgtctgactataacagtctctagtggtgcacctaattggatatcttttgattgtgtgatcaaactagcttcgtgacgacccaatgcatggttccattcagaatgaaagtaccaatcctcttcattgaaaatctttctgtcgccttttggatgaaacaatgaattcgcatagcttagtgaggcaagagcaaatggaactactccatctgcggtgtaggctcttaagattttcgtaggaagtttacatgaatctagagacactataatggatgattgagttggggatgtagacagagcagattgggcgatatttctgaggaaagatgcagcattatctcgtgagaagttaccgatggttaacccaaataacagtatacatcttggtctgttcctaatatcaggagcgttttgtaaccagtgaagtccatcgtcaaaagtgccatgtaaggctgcgaatctaacatagtggaatctgtccactggaatggcttgaaaattagatgctaattcagagtaggacaggtccaaggcgtagtaagaagctttgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattatgcagatgttataatatctgtgcgtggcgcgtccggctgtctgccatgctgcccggtgtaccgacataaccgccggtggcatagccgcgcatacgcgccatttccttccatcttgtgattcatgctatccatcttttttgagtatccaattaacgaagacgttaccagctgattgaaggttctcaaagtgactgtactccatgttttcttatcatccatgtagttatttttcaaactgcaaattcaagaaaaagccacgcgtgtgcaccttttttttccccttccagtgcattatgcaatagacagcacgagtctttgaaaaagtaacttataaaactgtatcaatttttaaacctaaatagattcataaactattcgttaatataaagtgttctaaactatgatgaaaaaataagcagaaaagactaataattcttagttaaaagcactccgcggtcaaacaacggaagcagacaaagaacccaagaaagattgaacccacttaacagcaacattccaagcaccttgtcttgtttgtctacacataccttcagcatcccaagcatcaccatcaatacccaatttggagaagaacaaaccttctggatcccatcttctcttaacttcaaccaatctagcgtagttagaaccccaataaacttctctggatcttctttcggatggatcacccaaatttctgtaggagatttggaaggctggttcaatttcgtataatctggccatttgaacggtttgcaattcatgtaaagcagtagctttagcagccaaagatggagcaccaacacctctaacgaaattcaataattgagcagcatctctccaacctggatgcatagcagtagaagctggatctctattcaatgaagagactctaccacccaagttagaagtgaacaacaaatcatctggagtcattggcaatctagcaaaatgttgtgccaaagcagctggaccagtagcagaattaaacaagtccaaggaaaccaaaacggaacccatcaaaataccgtaatcttctgggtatctatcagcggtatgtctgaaagtagaagagatttgtggcaagaatctagaggtcaattggtatggatgaccattatgttccaaagctcttctcaaaggatccattctttcgtcagcaacagctggaacagtcaagttagagaagtacatagtcaaactagcttggacggtatcatcatcagtgtttctcaaaatgaattgaccggcagtaccatggttgttcaagaattgtaaagctctcaacaaagcagcaacaccatgtgaccaaaaagtagcatcagctctagaaccagtaacaacagcatcagcaacagaaactggcaaatctggatgaacttgcaatgtagcttgagtaacaacaccaaaagtaccaccaccaccgcctctcaaagcccaaaacaaatctgggttttgatgagcgttagcaataacgatttcacccttagcagtaacaacttcgtattccaagacgttatcaacagccaaaccatgagcataagacaaccaagaagaaacaccaccaccttgtaaaaaaccaccagcagcaccaactgttggacattcaccaccaacaactatccaaccttcagaagcacctctagcatacaagtcacccaacaaaataccagcaccaacagtaacagctggttgacctggagcagattgtctttcagaggaaccagctggtctaaaatttggatggtattgaacggagttcaagtgatgggtatgaatttcaacagaatctggaccagatgatctaccagaaccatcatgaccggtgtttctaataaccaatctcaagttgtgttgtctggtgaaatcaacaaccttttgaacatcagaagcggacttaacagcagcggaatataatggaattctaccttgatgacaagaaccagctggacctgatctcaagtagtaacaagtttgattagattcagcaccaccttcccaaacccaatcttgtaaagcaccagtatgagaagcacgccacttagaatccaaggattcttgtaaaacttgttcgcaagcagaagaatcttgaccggattgatgacaaacatgagcaattggcttaacatgagccaaagcaccaccaatagattcgttcaaagtagaccaatgagaaacagttggccaacatggttcacctggtctacatctgcaatcatgtctatcatcatcaacagcagacaatctagacaagtaggcaccaaccaaaataaccaagatcaattgtctaacaccacccaaaatacctctggattgacccataagctttttgtaattaaaacttagattagattgctatgctttctttctaatgagcaagaagtaaaaaaagttgtaatagaacaagaaaaatgaaactgaaacttgagaaattgaagaccgtttattaacttaaatatcaatgggaggtcatcgaaagagaaaaaaatcaaaaaaaaaaattttcaagaaaaagaaacgtgataaaaatttttattgcctttttcgacgaagaaaaagaaacgaggcggtctcttttttcttttccaaacctttagtacgggtaattaacgacaccctagaggaagaaagaggggaaatttagtatgctgtgcttgggtgttttgaagtggtacggcgatgcgcggagtccgagaaaatctggaagagtaaaaaaggagtagaaacattttgaagctaggcgcgtcagccggtaaagattccccacgccaatccggctggttgcctccttcgtgaagacaaactcacgcgcctccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaaccgcggtcacaatctagctggaataaaagattcttcagctggagcttcagacttttgcaacaaggtttcaacacctttttgaattctagcagccaaagctggagaaaccaacttccaggtttcgtaaacttgcttttgaatttcggctctggtttgagcaacagattcaaccatgttttggaccatggtatcttggaattcttgacctctaaaatctggcaaaacttcgtagaaatctctggcgaacttgtaatcatgttcagtagtttgcaaccaggacttggattggatttctttcaaccattcattatactttggatctggttctctaggttcggcaaatctaactggttgttgttgagtcaagaaacctggatgagcaccataattagcatcaaaagtaccttgaccatctctagcaattgggttaaaggtatgagcggatctattaactgggatttgttgatggttagcacccaatctatatctttgagcgtctgggtaagcgaaaattctagcttgtaaaattggatcttcagatggagcaacacctggaaccatgttagatggagagtaagccaattgttcaatttcggcgaagtagttagctgggtttcttttcaaagtcaacttaccgaaaacctttggtgggatcaaagtaacatcttttgggtaagtacccaagttccagtgcttagtaacatccaaaatgttgtaacccaagtttggagcatcttttggatcaacaacttgaacagaagcagtccaagttgggtattcacctctttcaatagcttcatacaagtctctagtagcgtgatctggatccaaatcatttgtacctttagcttgttgaccatcggtgaaatttggacctctatcagatgacaagaagatgtggacgtacttaaaagaaccatctggcttaacccatttgtaagcatgagccatataaccagacatggatctccaattgaacatagtaccgaaatcagaaaattgcaacaagaccatgtgcaaggattcatgattgttggtaacccaatcccagtacatgtttgggttcaacaaattagtttgtggatctcttctttgagcgtgcatcaaagatgggaacttgactggatcacgaatgaagaagaatgggaaattcaacatgacccaatcccaattaccttcagtagtgtagaacttacaagccatacctttcaaatctctcataccttcgttagaacctctttccaaaccagtggtagagaatctagtaacacatggagtctttttaccgacaccaaccaacatatcgatatcgcaaatatcggagatatcggcagtaacttcaaattcaccataagcaccagcacctttagcgtgaacaactctttctggaatcttttctctgttgaaatgggccaaggtatcaaccaaatgatgatcagacaaagccaaagttctaccatcagctggtggaccttcaggcttatgaaatggacaaccattagcagtagtgtaagttggcttagaatctggagccataagctttttgatagatttgactgtgttattttgcgtgaggttatgagtagaaaataataattgagaaaggaatatgacaagaaatatgaaaataaagggaacaaacccaaatctgattgcaaggagagtgaaagagccttgtttatatatttttttttcctatgttcaacgaggacagctaggtttatgcaaaaatgtgccatcaccataagctgattcaaatgagctaaaaaaaaaatagttagaaaataaggtggtgttgaacgatagcaagtagatcaagacaccgtctaacagaaaaaggggcagcggacaatattatgcaattatgaagaaaagtactcaaagggtcggaaaaatattcaaacgatatttgcataaaatcctcaattgattgattattccatagtaaaataccgtaacaacacaaaattgttctcaaattcataaattattcattttttccacgagcctcatcacacgaaaagtcagaagagcatacataatcttttaaatgcataggttatgcattttgcaaatgccaccaggcaacaaaaatatgcgtttagcgggcggaatcgggaaggaagccggaaccaccaaaaactggaagctacgtttttaaggaaggtatgggtgcagtgtgcttatctcaagaaatattagttatgatataaggtgttgaagtttagagataggtaaataaacgcggggtgtgtttattacatgaagaagaagttagtttctgccttgcttgtttatcttgcacatcacatcagcggaacatatgctcacccagtcgcatggcgcgt

SEQ ID NO: 174 - DNA, 13250 bp, Artificial Sequence
  HRT5 containing EasD, EasH, EasA, and EasG
accacggtgaacaatccccgctggctcatatttgccgccggttcccgtaaatcctccggtacgctccagcgtgttttatctctgcgagcataatgcctgcgtcatccgccagcaggagctggactttactgatgcccgttatatctgcgaaaagaccgggatctggacccgtgatggcattctctggttttcgtcatccggtgaagagattgagccacctgacagtgtgacctttcacatctggacagcgtacagcccgttcaccacctgggtgcagattgtcaaagactggatgaaaacgaaaggggatacgggaaaacgtaaaaccttcgtaaacaccacgctcggtgagacgtgggaggcgaaaattggcgaacgtccggatgctgaagtgatggcagagcggaaagagcattattcagcgcccgttcctgaccgtgtggcttacctgaccgccggtatcgactcccagctggaccgctacgaaatgcgcgtatggggatgggggccgggtgaggaaagctggctgattgaccggcagattattatgggccgccacgacgatgaacagacgctgctgcgtgtggatgaggccatcaataaaacctatacccgccggaatggtgcagaaatgtcgatatcccgtatctgctgggatactggcgttttcccgtctttcagtgccttgttcagttcttcctgacgggcggtatatttctccagcttacgcgccgttaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcatgccacgttcgctcgcgtatcggtgattcattctgctaaccagtaaggcaaccccgccagcctagccgggtcctcaacgacaggagcacgatcatgcgcacccgtggccaggacccaacgctgcggggggggggggggggttttctttccaattttttttttttcgtcattataaaaatcattacgaccgagattcccggccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaacccccccccccccccccgatgcgccgcgtgcggctgctggagatggcggacgcgatggatatgttctgccaagggttggtttgcgcattcacagttctccgcaagaattgattggctggatctgatatccctgcatggcgcgttcatcgtccacctccggagaacaggccaccatcacgcatctgtgtctgaatttcatcacgacgcgccttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtattggaccaccctgtgggtttataagcgcgctgctggcgtgtaaggcggtgacggcgaaggaagggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacggcgcgtggcacccttgcgggccatgtcatacaccgccttcagagcagccggacctatctgcccgttacgcgccagcttgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgatatcgacaaaggaaaagggggacggatctccgaggcctcggacccgtcgggccgccgtcggacgtgccgcggttatggagttgcagcaccaacgttaatattggcaccgtaaactggtctagaatcttcagacaacaaccagacgatagttctagcaacatcttcaggttgaatgattgggaaaccttctttgatgtaggcttcttttacttcgtcgatagatttagcttgtggcatgaattgtggcaaagctggagtatcggtaatacctggagaaacagaattgattctaatacccaatggccaagcatccatagcagcacaagaagtaaagtaagcacaagcacctttagaagtaccgtaagcataagcatctggcaaatggataaaggcagcaatggaaccaatgttaacgatagctctatcttttggacctggcaaagccttcatagctctaataccagctctagtacagtagaaaacaccgtccaagttaaccttgaaaactctttgccattcttcatcagtttcttccaacaaagctggagcttgtctagcaccagctggttgagcaataccagcaacattagccaaaccatgcaagtcaccaaaagtttgaacgatagtttgcaaccaagcatcaacttcagcggatgaagaaacatccaatctagtgcaatgaacctttgtagctggattcaaggcttgaatatcagaggtaacggattcgaaaccctttggagaaatatcaccaatgcatataacagcagcacctctagcagccaataatctacaagtagcagcaccaataccagaagcaccaccagtaacagcgaaaattctagagttgacaacggtcataagctttttgtttgtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgtccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgggcgcgtcgtgccgtcgttgttaatcaccacatggttattctgctcaaacgtcccggacgcctgcgaacgcgccgaaggaaaatgagaaatatcgagggagacgattcagaggagcaggacaaactataaccgactgtttgttggaggatgccgtacataacgaacactgctgaagctaccatgtctacagtttagaggaatgggtacaactcacaggcgagggatggtgttcactcgtgctagcaaacgcggtgggagcaaaaagtagaatattatcttttattcgtgaaacttcgaacactgtcatctaaagatgctatatactaatataggcatacttgataatgaaaactataaatcgtaaagacataagagatccgcgggacaaatgtggatcttcgatgtggttttccataaaccaagttggtcttaagacgacgtacttaacaccttctttagaatccaaatgagcatgagcttcacccatcattggatcacctttttcagtgttagaagcagaaaccaaagcgtatcttctaacacctctagaatgagccaaatcgatgaattcgaacattggatgaacaaattctggagcatgagcaccaaccaaatagatagcagtaataggttctggagcttgatcccaagcattagtccaagtatccttgttcaaccagtcaaaatgagcggttctataagtagcaattggagcagtagaagaagtaccgacaacaaaagggatttgagcttcatgcaacaaagcagacaatctagaagcagttttacctctaccacccaaaaccaagatggtcatttacaaccaatgttctctgttttctctagcgtaatcaacaaatcttctaggtggtctaccagtaaccttttcaacgtcttgagaaactctttcttcagcaccagtagcaacagcagcttccatagtagccaacatttcagcaaaatctggtggcaaaccagcagtatcaaccaagaattgaccgaacttttcagctggcaaagtaacatgggtaatctttctacccaacaaatcggtcaagatttcagccatatcagcataagacaacaagtctggacccaaaaccatatattgttgttctttttgggtcaatggttgagtcaaagcatgaaaagcaactctggcaatatcatcagcagaaacaaatggaatcttacctggaccagtagcagagtagattttgttttcggtcttaatccaaaagctttgttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattatgcagatgttataatatctgtgcgtggcgcgtccggctgtctgccatgctgcccggtgtaccgacataaccgccggtggcatagccgcgcatacgcgccatttccttccatcttgtgattcatgctatccatcttttttgagtatccaattaacgaagacgttaccagctgattgaaggttctcaaagtgactgtactccatgttttcttatcatccatgtagttatttttcaaactgcaaattcaagaaaaagccacgcgtgtgcaccttttttttccccttccagtgcattatgcaatagacagcacgagtctttgaaaaagtaacttataaaactgtatcaatttttaaacctaaatagattcataaactattcgttaatataaagtgttctaaactatgatgaaaaaataagcagaaaagactaataattcttagttaaaagcactccgcggttaggccttcttagcaacttgattagacttcaagtcaataccggtagccaaatccttcaaatcgtaggtccaaatatcaacacccttagcagaaacagttctccaaccaaccattttttgggccaatggagtcatagtttcaaccaattctcttggcaaagcaacactagcttcaactggagtgaattgacaagattgcatgatcaatgggaaacctcttctcaaaaaatcagtagtgttgttcttaccggcaccatgtaaagttttaccagtaaacaaaacagcatcacctggattcataacagctggaatagcagtatcagcttttggtggtggagcagaaaaatcttcccacaaatgagaacctggcaaaactctagtagcaccattttcagcagtgaaatcagtcaaagcagtcaagaagttcaacatagattctggagattgtctacccaaggtagtacagattggaataccatcatgttctctatgcaattcttgaccatggtaacctggttcagtttccaaaacagaagaagtagtcaaccagtaatcaccagattctggaccgaataatctcttgcacaaaccgtgcaataattcgtcgttcatcaattcatctctgaacaacttggagaacaaaggcaaagatgacaattgtctcataccagccaagtaagattcttggtaggatttttgacccaattcccattgcttcatgtgtggatcaatttcaccgttgaatcttctaacttggtcagcagacatgaaaccttcgataacaacaacgccatcttcttgcaagacttggaaaatagcttcatcaccagctgatcttggaattcttctcaaggttggcttagaagtttcggtaatggtcataagctttttgtaattaaaacttagattagattgctatgctttctttctaatgagcaagaagtaaaaaaagttgtaatagaacaagaaaaatgaaactgaaacttgagaaattgaagaccgtttattaacttaaatatcaatgggaggtcatcgaaagagaaaaaaatcaaaaaaaaaaattttcaagaaaaagaaacgtgataaaaatttttattgcctttttcgacgaagaaaaagaaacgaggcggtctcttttttcttttccaaacctttagtacgggtaattaacgacaccctagaggaagaaagaggggaaatttagtatgctgtgcttgggtgttttgaagtggtacggcgatgcgcggagtccgagaaaatctggaagagtaaaaaaggagtagaaacattttgaagctaggcgcgtcagccggtaaagattccccacgccaatccggctggttgcctccttcgtgaagacaaactcacgcgcctccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaaccgcggtcacaatctagctggaataaaagattcttcagctggagcttcagacttttgcaacaaggtttcaacacctttttgaattctagcagccaaagctggagaaaccaacttccaggtttcgtaaacttgcttttgaatttcggctctggtttgagcaacagattcaaccatgttttggaccatggtatcttggaattcttgacctctaaaatctggcaaaacttcgtagaaatctctggcgaacttgtaatcatgttcagtagtttgcaaccaggacttggattggatttctttcaaccattcattatactttggatctggttctctaggttcggcaaatctaactggttgttgttgagtcaagaaacctggatgagcaccataattagcatcaaaagtaccttgaccatctctagcaattgggttaaaggtatgagcggatctattaactgggatttgttgatggttagcacccaatctatatctttgagcgtctgggtaagcgaaaattctagcttgtaaaattggatcttcagatggagcaacacctggaaccatgttagatggagagtaagccaattgttcaatttcggcgaagtagttagctgggtttcttttcaaagtcaacttaccgaaaacctttggtgggatcaaagtaacatcttttgggtaagtacccaagttccagtgcttagtaacatccaaaatgttgtaacccaagtttggagcatcttttggatcaacaacttgaacagaagcagtccaagttgggtattcacctctttcaatagcttcatacaagtctctagtagcgtgatctggatccaaatcatttgtacctttagcttgttgaccatcggtgaaatttggacctctatcagatgacaagaagatgtggacgtacttaaaagaaccatctggcttaacccatttgtaagcatgagccatataaccagacatggatctccaattgaacatagtaccgaaatcagaaaattgcaacaagaccatgtgcaaggattcatgattgttggtaacccaatcccagtacatgtttgggttcaacaaattagtttgtggatctcttctttgagcgtgcatcaaagatgggaacttgactggatcacgaatgaagaagaatgggaaattcaacatgacccaatcccaattaccttcagtagtgtagaacttacaagccatacctttcaaatctctcataccttcgttagaacctctttccaaaccagtggtagagaatctagtaacacatggagtctttttaccgacaccaaccaacatatcgatatcgcaaatatcggagatatcggcagtaacttcaaattcaccataagcaccagcacctttagcgtgaacaactctttctggaatcttttctctgttgaaatgggccaaggtatcaaccaaatgatgatcagacaaagccaaagttctaccatcagctggtggaccttcaggcttatgaaatggacaaccattagcagtagtgtaagttggcttagaatctggagccataagctttttgatagatttgactgtgttattttgcgtgaggttatgagtagaaaataataattgagaaaggaatatgacaagaaatatgaaaataaagggaacaaacccaaatctgattgcaaggagagtgaaagagccttgtttatatatttttttttcctatgttcaacgaggacagctaggtttatgcaaaaatgtgccatcaccataagctgattcaaatgagctaaaaaaaaaatagttagaaaataaggtggtgttgaacgatagcaagtagatcaagacaccgtctaacagaaaaaggggcagcggacaatattatgcaattatgaagaaaagtactcaaagggtcggaaaaatattcaaacgatatttgcataaaatcctcaattgattgattattccatagtaaaataccgtaacaacacaaaattgttctcaaattcataaattattcattttttccacgagcctcatcacacgaaaagtcagaagagcatacataatcttttaaatgcataggttatgcattttgcaaatgccaccaggcaacaaaaatatgcgtttagcgggcggaatcgggaaggaagccggaaccaccaaaaactggaagctacgtttttaaggaaggtatgggtgcagtgtgcttatctcaagaaatattagttatgatataaggtgttgaagtttagagataggtaaataaacgcggggtgtgtttattacatgaagaagaagttagtttctgccttgcttgtttatcttgcacatcacatcagcggaacatatgctcacccagtcgcatggcgcgt

SEQ ID NO: 175 - protein, 607 aa, Artificial Sequence
  Arthoderma otae sequence with improved N-terminus
MQSLFLTTGLVALLSWLVYTGRNQVTSCRCRPWQPCWPSEELWNSFNTSIDGKLQQLKPAAHVCYEPNFDKGACDDLLRLSRDSGWRASHPGVLQDWVWEAGESANETCPMGSLQTATAAKSCHQGRIPLYSATVESAQQVQQAVRFARRHNLRLVIRNTGHDLAGRSSAPDSFQIHTHRLQETQFHTDLRLNGSTASLGPAVTVGAGVMMGNLYARAAREGYMVLGGDCPTVGVAGGFLQGGGVSDFLSLNQGLGVDNVLEYEIVTADGELLVANTLQNQELFWALRGGGGGTFGVVTRATMRVFPDVPAVISEVLLQAPQTNSSSWTEGLSVILNALQSLNRDDVGGQLVIAVQPELAVQASIKFFFLNSTETTIIDERMKSLLTDLNRIDIQYTLSSKALPHFSSNYRQVPDIHSDNDYGVIGSTVAISKELFDSSQGPQKIARALANLPMSPGDLLFTSNLGGRVISNGEIAETSMHPAWRAASQLLNYIHAVGPSIESRVNALERLTNVQMPMLYAIDPNFRLSYRNVGDPNEKDFQQVYWGSNYKRLSQIKKRWDSDGLFFSKLGVGSELWDSEGMCRKNQSVVRQAVNYLMSFATSMVEG

SEQ ID NO: 176 - protein, 602 aa, Artificial Sequence
  Aspergillus fumigatus sequence with improved N-terminus
MPFVFSFLLGAFLSCIWLSLSGGSTCRCRPGESCWPSPSEWAALNTTLRGDLVEVRPIAHICHDPFYDHSACQNLRDLAKDSGWRASQAGTLQGWVWEVGRTEDETCHAHSPRGAPCHQGRIPLYSAAVESVDQIQVAVRFAQRHRLRLVVRNTGHDTAGRSSGSDSFQIHCHRMKQIEYHDNFRALGSDIDRGPAVSVGAGVTLGEMYARGARDGWVVVGGECPTVGAAGGFLQGGGVSSFHSFIDGLAVDNVLEFEVVTAKGDVVVANDHQNPDIFWALRGGGGGTFGIVTRATMRVHLNSPVCVSEVAVSGLRNNSLLWTKGITGLFSILRSFNQQGIPGQFILRPLSKDQVNASLTLYSLNTDDTRRSAENMLSIRNILESTTLPFTLASRCLPKISDALRKGPDMLPVNYGIITGSVLVSEDLFNSEEGPLHLAKQLEHFPMGPMDLLFTSNLGGNVSANTGKKHRDTSMHPGWRQAAHLINFVRSVSTPTAHEKARSLEELHSVQMRQLYDIEPDFRVSYRNLGDPLESDAAQVYWGPNYKRLLEIKRKWDPEDLFFSQLGVGSEGWTEDQMCKRQQRLQQMLQYLMSSIAQRVYR

SEQ ID NO: 177 - protein, 607 aa, Artificial Sequence
  Arthroderma gypseum sequence with improved N-terminus
MQFLFLTTGLVALLSWLIYTQETQPASCRCRPWESCWPSEEIWNSLNSSVDGNLHRLKPAAHVCYGSSFNQSACDDMLLLSRNSGWRASNPGVLQDWVWEAGETANETCPVGSLRTVSAVNSCHQGRIPLYSVGVESAQQVQKAVRFARRHNLRLVIRNTGHDLAGRSSAPDSFQIHTHRLQEIHFHTNLRLNGSNASLGPAVTVGAGVMMGNLYSQAARNGYMVLGGDCPTVGVVGGFLQGGGVSDFLSLNQGLGVDNVLEYEVVTADGEIVVANALQNQDLFWALRGGGGGTFGVVTRATMRVFPDVPVVISEILLEASKSNSSSWTQGLSVVLTALQSLNRENVGGQLVIVVLPKLAVQASIKFFFLDATETAAIDHRMKSFLTELSRANVKYAYSSKGLPHFSSNYRQVPDIHADNDYGVLGSTVAISQQLFDSPQGPEKVANALANLPMSPGDLLFTSNLGGRVILNGGLAETSMHPAWRAASQLLNYVHTVEPSIEGRAKAREKLTNIQMPMLYAIDPKFKLSYRNVGDPNEKNFQQVYWGSNYGRLSDIKKKWDTTDLFFSKLGIGSEKWDSEGMCRKHQEAFYQKMRRFISLTTFTLKN

SEQ ID NO: 178 - protein, 583 aa, Artificial Sequence
  Arthroderma benhamiae sequence with improved N-terminus
MQFLLWSTGLVALLSWLIYTQETQPASCRCRPWESCWPSEELWNSFNTSVDGKLHRLRPAAHVCYGPSFNRSACDNILLLSRDSGWRASNPGVLQDWVWEAGETANESCPVGSLRTASAVNSCHQGRIPLFTVGVESTKQVQEAVRFARKHNLRLVIRNTGHDLAGRSSAPDSFQIHTHHLQEIQFHADMRLDGSNTSLGPAVTVGAGVMMGNLYAQAARHGYMVLGGDCPTVGVVGGFLQGGGISDFLSLNQGFGVDNVLEYEVVTADGELVVANALQNQDLFWALRGGGGGTFGVVTRATMRVFPDVPVVISEILLEAPQAISSSWTQGLSIVLTALQSLNRDNVGGQLVIAVLPKLAVQASIKFFFLDATEATVIDRRMKPFLTKLSRANVKYTYSSKNLPHFSSNYRQVPDIHSDNDYGVLGSTVAISQQLFDSPQGPEKVATALANLPVSAGDLIFTSNLGGRVISNGELAETSMHPAWRSASQLINYVHTVEPSIEGRAKARERLTNTQMPMLYALDPNLKLSYRNVGDPNEKDFQQIYWGPNYGRLSNIKKKWDTDDLFFSKLGVGSERWDSEARR

SEQ ID NO: 179 - protein, 429 aa, Artificial Sequence
  DmaW variant based on Aspergillus japonicus DmaW sequence
MTAGQGIKTGNASDCEVYRTLSVALDFANQDEELWWHSTAPMFAQMLQSTNYNLHAQYKHLLIYKKNVIPFLGVYPTNDKPRWLSILTRYGTPFELSLNCSGPLVRYTYEPINAATGTARDPFNTHAVWDSLEQLMALQSGIDLDLFRHFKNDLTLSAEESEYLYKNNLVGEQIRTQNKLALDLQDGEFVVKTYIYPALKSLATGRSIHELVFGSAFRWSKQYPELRKPLDTLEQYVYSRGPSSTASPRLLSCDLIDPTKSRIKIYLLERMVTLEALEDLWTMGGERTDASTLAGLEMIRELWELIRLPAGLQSYPAPYLPIGTIPDEQLPLMANYTIHHDDPVPEPQVYFTTFGRNDMQIADALATFFERRGWHEMARQYKAELCSHYPHADHETLNYLHAYISFSYRKNKPYLSVYLQSLETGDWVT

SEQ ID NO: 180 - protein, 461 aa, Paecilomyces divaricatus
MSSRKTRNASSSEVYQTLSSLFDFPDEEQKLWWHSTAPMFADMLQTANYDTHAQYRHLGIYKKYVIPFLGVYPTNDRDRWLSILTRYGTPFELSLNCSDDVVRYTFEPINAATGTIQDPFNTHAIWDCLQNFSPMLKGVDLEWFSYFKEKLTLNADESAFLVENNLADDPIKTQNKLALDLKNSGFVLKTYIYPALKSIATGKSIWELMFNSVSRLSPQYPGLAAPLSVIDEYVHSRGPNGTAGPRLFSCDLVHPSKSRIKIYILERMVSLAAMEDLWTLGGRRKDHSTLAGLNMIRELWELIQLPAGLRSYPEPYLPLGTIPNEQLPLMANYTLHQDDPWPEPQVYFTPFGMNDMAIADALTTFMERRGWNDMAQSYKDNLCSYYPNADHDHLNYVHAYISFSYRNDKPYLSVYLHSFETGDWKISNFTNPESKCKEPQRVSVRFPVQGRGRGRIPASGY

SEQ ID NO: 181 - protein, 288 aa, Artificial Sequence
  Neotyphodium lolii sequence with improved N-terminus
MTILLTGGRGKTASHIASLLQAAKVPFIVASRSSDPSSSSPYYQNCFDWLDEKTYGDVLTSKDSMQPISTIWLVPPPIFDLAPLMIKFVDFASRKGVKRFVLLSASTIKKGGPAMGQVHEYLASLGGIEYAVLRPTWFMENFSYPQELQRLAIKNENKIYSAAGDGKLPFVSVADIARVAFRTLTDEKSHNTDYVLLGPELITYDQVAETLSTVLGRTITHIKLTEEELVKRLENSGMPAEDAKMLAGMDTSISDGAEDRLNNVVKHVTGADPRTFLDFATHQKATWG

SEQ ID NO: 182 - protein, 451 aa, Artificial Sequence
  DmaW consensus sequence 2
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  misc_feature (8)..(9): Xaa can be any naturally occurring amino acid
  misc_feature (13)..(13): Xaa can be any naturally occurring amino acid
  misc_feature (17)..(18): Xaa can be any naturally occurring amino acid
  misc_feature (24)..(24): Xaa can be any naturally occurring amino acid
  misc_feature (27)..(27): Xaa can be any naturally occurring amino acid
  misc_feature (39)..(39): Xaa can be any naturally occurring amino acid
  misc_feature (47)..(48): Xaa can be any naturally occurring amino acid
  misc_feature (50)..(50): Xaa can be any naturally occurring amino acid
  misc_feature (53)..(53): Xaa can be any naturally occurring amino acid
  misc_feature (72)..(73): Xaa can be any naturally occurring amino acid
  misc_feature (75)..(75): Xaa can be any naturally occurring amino acid
  misc_feature (96)..(96): Xaa can be any naturally occurring amino acid
  misc_feature (98)..(98): Xaa can be any naturally occurring amino acid
  misc_feature (113)..(113): Xaa can be any naturally occurring amino acid
  misc_feature (120)..(120): Xaa can be any naturally occurring amino acid
  misc_feature (124)..(124): Xaa can be any naturally occurring amino acid
  misc_feature (128)..(128): Xaa can be any naturally occurring amino acid
  misc_feature (130)..(132): Xaa can be any naturally occurring amino acid
  misc_feature (134)..(134): Xaa can be any naturally occurring amino acid
  misc_feature (142)..(142): Xaa can be any naturally occurring amino acid
  misc_feature (146)..(146): Xaa can be any naturally occurring amino acid
  misc_feature (151)..(153): Xaa can be any naturally occurring amino acid
  misc_feature (159)..(160): Xaa can be any naturally occurring amino acid
  misc_feature (163)..(163): Xaa can be any naturally occurring amino acid
  misc_feature (166)..(167): Xaa can be any naturally occurring amino acid
  misc_feature (182)..(183): Xaa can be any naturally occurring amino acid
  misc_feature (197)..(197): Xaa can be any naturally occurring amino acid
  misc_feature (207)..(207): Xaa can be any naturally occurring amino acid
  misc_feature (212)..(212): Xaa can be any naturally occurring amino acid
  misc_feature (216)..(218): Xaa can be any naturally occurring amino acid
  misc_feature (223)..(223): Xaa can be any naturally occurring amino acid
  misc_feature (226)..(227): Xaa can be any naturally occurring amino acid
  misc_feature (230)..(230): Xaa can be any naturally occurring amino acid
  misc_feature (233)..(233): Xaa can be any naturally occurring amino acid
  misc_feature (237)..(248): Xaa can be any naturally occurring amino acid
  misc_feature (259)..(259): Xaa can be any naturally occurring amino acid
  misc_feature (262)..(262): Xaa can be any naturally occurring amino acid
  misc_feature (278)..(278): Xaa can be any naturally occurring amino acid
  misc_feature (291)..(291): Xaa can be any naturally occurring amino acid
  misc_feature (293)..(293): Xaa can be any naturally occurring amino acid
  misc_feature (296)..(297): Xaa can be any naturally occurring amino acid
  misc_feature (300)..(300): Xaa can be any naturally occurring amino acid
  misc_feature (307)..(307): Xaa can be any naturally occurring amino acid
  misc_feature (310)..(311): Xaa can be any naturally occurring amino acid
  misc_feature (313)..(313): Xaa can be any naturally occurring amino acid
  misc_feature (316)..(317): Xaa can be any naturally occurring amino acid
  misc_feature (320)..(320): Xaa can be any naturally occurring amino acid
  misc_feature (327)..(327): Xaa can be any naturally occurring amino acid
  misc_feature (330)..(330): Xaa can be any naturally occurring amino acid
  misc_feature (344)..(344): Xaa can be any naturally occurring amino acid
  misc_feature (347)..(347): Xaa can be any naturally occurring amino acid
  misc_feature (363)..(363): Xaa can be any naturally occurring amino acid
  misc_feature (365)..(365): Xaa can be any naturally occurring amino acid
  misc_feature (378)..(379): Xaa can be any naturally occurring amino acid
  misc_feature (382)..(382): Xaa can be any naturally occurring amino acid
  misc_feature (387)..(387): Xaa can be any naturally occurring amino acid
  misc_feature (389)..(390): Xaa can be any naturally occurring amino acid
  misc_feature (395)..(395): Xaa can be any naturally occurring amino acid
  misc_feature (399)..(399): Xaa can be any naturally occurring amino acid
  misc_feature (413)..(413): Xaa can be any naturally occurring amino acid
  misc_feature (432)..(439): Xaa can be any naturally occurring amino acid
  misc_feature (442)..(443): Xaa can be any naturally occurring amino acid
  misc_feature (446)..(450): Xaa can be any naturally occurring amino acid
MXTXNXSXXEVYXTLSXXFDFPNXDQXLWWHSTAPMFAXMLQTANYXXHXQYXHLGIYKKHVIPFLGVYPTXXKXRWLSILTRYGTPFELSLNCSXSXVRYTYEPINAATGTXKDPFNTXAIWXSLQXLXXXQXGIDLEWFXYFKXELTLXXXESAYLXXNNXLVXXQIKTQNKLALDLKGXXFVLKTYIYPALKSXATGKSIHELXFGSVXRLSXXXPSIRXPLXXLEXYVXSRNXXXXXXXXXXXXLSPRLLSCDLXDPXKSRVKIYLLERMVSLXAMEDLWTLGGRRXDXSTXXGLXMIRELWXLLXXPXGLXXYPXPYLPLGXIPXEQLPSMANYTLHHXDPXPEPQVYFTVFGMNDMXVXDALTTFFERRGWXXMAXKYKAXLXXSYPHXDHEXLNYLHAYISFSYRXNKPYLSVYLHSFETGDWPXXXXXXXXFDXXRRXXXXXK

SEQ ID NO: 183 - protein, 299 aa, Artificial Sequence
  EasG consensus sequence 2
  misc_feature (15)..(15): Xaa can be any naturally occurring amino acid
  misc_feature (21)..(22): Xaa can be any naturally occurring amino acid
  misc_feature (24)..(26): Xaa can be any naturally occurring amino acid
  misc_feature (37)..(38): Xaa can be any naturally occurring amino acid
  misc_feature (40)..(41): Xaa can be any naturally occurring amino acid
  misc_feature (46)..(48): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(70): Xaa can be any naturally occurring amino acid
  misc_feature (73)..(73): Xaa can be any naturally occurring amino acid
  misc_feature (77)..(77): Xaa can be any naturally occurring amino acid
  misc_feature (82)..(82): Xaa can be any naturally occurring amino acid
  misc_feature (86)..(86): Xaa can be any naturally occurring amino acid
  misc_feature (100)..(100): Xaa can be any naturally occurring amino acid
  misc_feature (124)..(124): Xaa can be any naturally occurring amino acid
  misc_feature (133)..(134): Xaa can be any naturally occurring amino acid
  misc_feature (137)..(137): Xaa can be any naturally occurring amino acid
  misc_feature (139)..(139): Xaa can be any naturally occurring amino acid
  misc_feature (152)..(154): Xaa can be any naturally occurring amino acid
  misc_feature (157)..(157): Xaa can be any naturally occurring amino acid
  misc_feature (160)..(160): Xaa can be any naturally occurring amino acid
  misc_feature (162)..(163): Xaa can be any naturally occurring amino acid
  misc_feature (181)..(182): Xaa can be any naturally occurring amino acid
  misc_feature (196)..(196): Xaa can be any naturally occurring amino acid
  misc_feature (198)..(198): Xaa can be any naturally occurring amino acid
  misc_feature (201)..(201): Xaa can be any naturally occurring amino acid
  misc_feature (236)..(236): Xaa can be any naturally occurring amino acid
  misc_feature (240)..(240): Xaa can be any naturally occurring amino acid
  misc_feature (243)..(244): Xaa can be any naturally occurring amino acid
  misc_feature (246)..(246): Xaa can be any naturally occurring amino acid
  misc_feature (250)..(250): Xaa can be any naturally occurring amino acid
  misc_feature (252)..(252): Xaa can be any naturally occurring amino acid
  misc_feature (254)..(254): Xaa can be any naturally occurring amino acid
  misc_feature (262)..(262): Xaa can be any naturally occurring amino acid
  misc_feature (265)..(265): Xaa can be any naturally occurring amino acid
  misc_feature (273)..(275): Xaa can be any naturally occurring amino acid
  misc_feature (278)..(278): Xaa can be any naturally occurring amino acid
  misc_feature (282)..(283): Xaa can be any naturally occurring amino acid
  misc_feature (292)..(294): Xaa can be any naturally occurring amino acid
  misc_feature (296)..(297): Xaa can be any naturally occurring amino acid
MTILLTGGRGKTASXIASLLXXAXXXVPFIVASRSSXXSXXSPYRXXXFDWLDEXTFGNXLSXXXXXXXXGMXPISXVWLVXPPIXDLAPPMIKFIDFAXSRGVKRFVLLSASTIEKGGPAMGXVHAHLDSLXXGVXYXVLRPTWFMENFSXXXELXWIXIXXENKIYSATGDGKIPFISXXDIARVAFRALTDEXSXNTXDYVLLGPELLTYDDVAEILTTVLGRKITHVKLTEXELAXKLXXEXGLPXDXAXMLASMDTXVKXGAEERLNXXXVKXVTGXXPRTFLDFAXXXKXXWL

SEQ ID NO: 184 - protein, 389 aa, Artificial Sequence
  EasA consensus sequence
  misc_feature (7)..(7): Xaa can be any naturally occurring amino acid
  misc_feature (10)..(10): Xaa can be any naturally occurring amino acid
  misc_feature (13)..(13): Xaa can be any naturally occurring amino acid
  misc_feature (15)..(16): Xaa can be any naturally occurring amino acid
  misc_feature (34)..(34): Xaa can be any naturally occurring amino acid
  misc_feature (38)..(38): Xaa can be any naturally occurring amino acid
  misc_feature (44)..(44): Xaa can be any naturally occurring amino acid
  misc_feature (63)..(63): Xaa can be any naturally occurring amino acid
  misc_feature (79)..(79): Xaa can be any naturally occurring amino acid
  misc_feature (88)..(88): Xaa can be any naturally occurring amino acid
  misc_feature (117)..(119): Xaa can be any naturally occurring amino acid
  misc_feature (121)..(121): Xaa can be any naturally occurring amino acid
  misc_feature (135)..(135): Xaa can be any naturally occurring amino acid
  misc_feature (148)..(149): Xaa can be any naturally occurring amino acid
  misc_feature (163)..(163): Xaa can be any naturally occurring amino acid
  misc_feature (166)..(166): Xaa can be any naturally occurring amino acid
  misc_feature (186)..(186): Xaa can be any naturally occurring amino acid
  misc_feature (190)..(190): Xaa can be any naturally occurring amino acid
  misc_feature (194)..(194): Xaa can be any naturally occurring amino acid
  misc_feature (237)..(237): Xaa can be any naturally occurring amino acid
  misc_feature (250)..(250): Xaa can be any naturally occurring amino acid
  misc_feature (256)..(261): Xaa can be any naturally occurring amino acid
  misc_feature (279)..(282): Xaa can be any naturally occurring amino acid
  misc_feature (286)..(288): Xaa can be any naturally occurring amino acid
  misc_feature (290)..(290): Xaa can be any naturally occurring amino acid
  misc_feature (297)..(307): Xaa can be any naturally occurring amino acid
  misc_feature (309)..(310): Xaa can be any naturally occurring amino acid
  misc_feature (319)..(319): Xaa can be any naturally occurring amino acid
  misc_feature (325)..(325): Xaa can be any naturally occurring amino acid
  misc_feature (329)..(330): Xaa can be any naturally occurring amino acid
  misc_feature (333)..(333): Xaa can be any naturally occurring amino acid
  misc_feature (335)..(336): Xaa can be any naturally occurring amino acid
  misc_feature (341)..(341): Xaa can be any naturally occurring amino acid
  misc_feature (358)..(358): Xaa can be any naturally occurring amino acid
  misc_feature (361)..(361): Xaa can be any naturally occurring amino acid
  misc_feature (374)..(374): Xaa can be any naturally occurring amino acid
  misc_feature (376)..(376): Xaa can be any naturally occurring amino acid
  misc_feature (386)..(386): Xaa can be any naturally occurring amino acid
SSSKLFXPLXVGXRXXLQHRIVMAPMTRFRADDXGVPXLPYVKXYYAQRASVPGTLLITEATXISPRAGGFPNVPGIWXEAQIAAWKXVVDAVHAKGSFIFLQLWATGRAADPDVLXXXGXFDLVSSSAVPVAPXGPVPRALTEDEIXXYIADYAQAAKNAVXAGXFDGVEIHGANGYLIDQFTQXSCNXRTDXWGGSIENRARFALEVTRAVVDAVGADRVGVKLSPWSTFQGMGXMDDLVPQFEYLIXRLREMXXXXXXLAYLHLANSRWLEEEDPXXXXHPDXXXEXFVRMWGXXXXXXXXXXXKXXPILLAGGYXADSAKXLVDXXYSXDXXNVLVXFGRHFISNPDLPFRLKXGIXLQKYDRDTFYIPXSXEGYLDYPFSXEFL

SEQ ID NO: 185 - protein, 606 aa, Artificial Sequence
  EasE consensus sequence 2
  misc_feature (4)..(4): Xaa can be any naturally occurring amino acid
  misc_feature (13)..(13): Xaa can be any naturally occurring amino acid
  misc_feature (17)..(18): Xaa can be any naturally occurring amino acid
  misc_feature (20)..(22): Xaa can be any naturally occurring amino acid
  misc_feature (38)..(38): Xaa can be any naturally occurring amino acid
  misc_feature (40)..(40): Xaa can be any naturally occurring amino acid
  misc_feature (49)..(49): Xaa can be any naturally occurring amino acid
  misc_feature (64)..(64): Xaa can be any naturally occurring amino acid
  misc_feature (67)..(67): Xaa can be any naturally occurring amino acid
  misc_feature (75)..(75): Xaa can be any naturally occurring amino acid
  misc_feature (89)..(89): Xaa can be any naturally occurring amino acid
  misc_feature (99)..(99): Xaa can be any naturally occurring amino acid
  misc_feature (110)..(110): Xaa can be any naturally occurring amino acid
  misc_feature (112)..(113): Xaa can be any naturally occurring amino acid
  misc_feature (115)..(117): Xaa can be any naturally occurring amino acid
  misc_feature (135)..(135): Xaa can be any naturally occurring amino acid
  misc_feature (139)..(139): Xaa can be any naturally occurring amino acid
  misc_feature (160)..(160): Xaa can be any naturally occurring amino acid
  misc_feature (181)..(181): Xaa can be any naturally occurring amino acid
  misc_feature (184)..(184): Xaa can be any naturally occurring amino acid
  misc_feature (189)..(189): Xaa can be any naturally occurring amino acid
  misc_feature (192)..(195): Xaa can be any naturally occurring amino acid
  misc_feature (200)..(200): Xaa can be any naturally occurring amino acid
  misc_feature (217)..(217): Xaa can be any naturally occurring amino acid
  misc_feature (221)..(221): Xaa can be any naturally occurring amino acid
  misc_feature (252)..(253): Xaa can be any naturally occurring amino acid
  misc_feature (269)..(269): Xaa can be any naturally occurring amino acid
  misc_feature (319)..(319): Xaa can be any naturally occurring amino acid
  misc_feature (321)..(322): Xaa can be any naturally occurring amino acid
  misc_feature (324)..(324): Xaa can be any naturally occurring amino acid
  misc_feature (330)..(330): Xaa can be any naturally occurring amino acid
  misc_feature (334)..(334): Xaa can be any naturally occurring amino acid
  misc_feature (354)..(357): Xaa can be any naturally occurring amino acid
  misc_feature (366)..(366): Xaa can be any naturally occurring amino acid
  misc_feature (375)..(375): Xaa can be any naturally occurring amino acid
  misc_feature (377)..(377): Xaa can be any naturally occurring amino acid
  misc_feature (380)..(380): Xaa can be any naturally occurring amino acid
  misc_feature (385)..(385): Xaa can be any naturally occurring amino acid
  misc_feature (388)..(388): Xaa can be any naturally occurring amino acid
  misc_feature (391)..(392): Xaa can be any naturally occurring amino acid
  misc_feature (395)..(395): Xaa can be any naturally occurring amino acid
  misc_feature (398)..(398): Xaa can be any naturally occurring amino acid
  misc_feature (402)..(402): Xaa can be any naturally occurring amino acid
  misc_feature (405)..(406): Xaa can be any naturally occurring amino acid
  misc_feature (409)..(409): Xaa can be any naturally occurring amino acid
  misc_feature (412)..(413): Xaa can be any naturally occurring amino acid
  misc_feature (421)..(421): Xaa can be any naturally occurring amino acid
  misc_feature (426)..(426): Xaa can be any naturally occurring amino acid
  misc_feature (434)..(434): Xaa can be any naturally occurring amino acid
  misc_feature (437)..(437): Xaa can be any naturally occurring amino acid
  misc_feature (443)..(443): Xaa can be any naturally occurring amino acid
  misc_feature (447)..(448): Xaa can be any naturally occurring amino acid
  misc_feature (451)..(451): Xaa can be any naturally occurring amino acid
  misc_feature (457)..(457): Xaa can be any naturally occurring amino acid
  misc_feature (474)..(475): Xaa can be any naturally occurring amino acid
  misc_feature (500)..(500): Xaa can be any naturally occurring amino acid
  misc_feature (509)..(509): Xaa can be any naturally occurring amino acid
  misc_feature (513)..(513): Xaa can be any naturally occurring amino acid
  misc_feature (517)..(517): Xaa can be any naturally occurring amino acid
  misc_feature (528)..(528): Xaa can be any naturally occurring amino acid
  misc_feature (551)..(551): Xaa can be any naturally occurring amino acid
  misc_feature (553)..(553): Xaa can be any naturally occurring amino acid
  misc_feature (559)..(559): Xaa can be any naturally occurring amino acid
  misc_feature (580)..(580): Xaa can be any naturally occurring amino acid
  misc_feature (590)..(593): Xaa can be any naturally occurring amino acid
  misc_feature (595)..(596): Xaa can be any naturally occurring amino acid
  misc_feature (598)..(598): Xaa can be any naturally occurring amino acid
  misc_feature (600)..(600): Xaa can be any naturally occurring amino acid
  misc_feature (602)..(603): Xaa can be any naturally occurring amino acid
  misc_feature (605)..(605): Xaa can be any naturally occurring amino acid
LLTXGLVALLSWXIYTXXTXXXSCRCRPWESCWPSEEXWXSLNTSIDGXLVRLRPIAHVCHGPXFDXSACDNLLXLSRDSGWRASNPGXLQDWVWEAGXTANESCPVGSXRXXSXXXSCHQGRIPLYSAAVESTXQVQXAVRFARRHNLRLVIRNTGHDXAGRSSAPDSFQIHTHRLQEIXFHXNFRLXGSXXXXTSLGXPAVTVGAGVMMGELYAXGARXGYMVLGGECPTVGVVGGFLQGGGVSSFLSFXXGLAVDNVLEYEVVTAXGELVVANAHQNQDLFWALRGGGGGTFGVVTRATMRVFPDVPVVVSEILLXAXXAXSSFWTXGLSXLLTALQSLNQDNVGGQLVIXXXXKDAVQASIXLFFLNMTEXAXIDXRMKPXLTXLSXXNIXYTXSSKXLPXXSSXLRXXPDIHPDNXYGILXSSVLISQXLFXSSEGPXKVAXXLAXLPMSPXDLLFTSNLGGRVIANGXXELAETSMHPAWRSAAQLINYVRTVXEPSIEGKAXALEXLTNXQMPILYAIDPXFKLSYRNLGDPNEKDFQQVYWGXNXYGRLSXIKKKWDPDDLFFSKLGVGSEXWDSEGMCRKXXXXQXXLXQXLXXLXS

SEQ ID NO: 186 - DNA, 1692 bp, Saccharomyces cerevisiae
atgagattaagaaccgccattgccacactgtgcctcacggcttttacatctgcaacttcaaacaatagctacatcgccaccgaccaaacacaaaatgcctttaatgacactcacttttgtaaggtcgacaggaatgatcacgttagtcccagttgtaacgtaacattcaatgaattaaatgccataaatgaaaacattagagatgatctttcggcgttattaaaatctgatttcttcaaatactttcggctggatttatacaagcaatgttcattttgggacgccaacgatggtctgtgcttaaaccgcgcttgctctgttgatgtcgtagaggactgggatacactgcctgagtactggcagcctgagatcttgggtagtttcaataatgatacaatgaaggaagcggatgatagcgatgacgaatgtaagttcttagatcaactatgtcaaaccagtaaaaaacctgtagatatcgaagacaccatcaactactgtgatgtaaatgactttaacggtaaaaacgccgttctgattgatttaacagcaaatccggaacgatttacaggttatggtggtaagcaagctggtcaaatttggtctactatctaccaagacaactgttttacaattggcgaaactggtgaatcattggccaaagatgcattttatagacttgtatccggtttccatgcctctatcggtactcacttatcaaaggaatatttgaacacgaaaactggtaaatgggagcccaatctggatttgtttatggcaagaatcgggaactttcctgatagagtgacaaacatgtatttcaattatgctgttgtagctaaggctctctggaaaattcaaccatatttaccagaattttcattctgtgatctagtcaataaagaaatcaaaaacaaaatggataacgttatttcccagctggacacaaaaatttttaacgaagacttagtttttgccaacgacctaagtttgactttgaaggacgaattcagatctcgcttcaagaatgtcacgaagattatggattgtgtgcaatgtgatagatgtagattgtggggcaaaattcaaactaccggttacgcaactgccttgaaaattttgtttgaaatcaacgacgctgatgaattcaccaaacaacatattgttggtaagttaaccaaatatgagttgattgcactattacagactttcggtagattatctgaatctattgaatctgttaacatgttcgaaaaaatgtacgggaaaaggttaaacggttctgaaaacaggttaagctcattcttccaaaataacttcttcaacattttgaaggaggcaggcaaatcgattcgttacaccatagagaacatcaattccactaaagaaggaaagaaaaagactaacaattctcaatcacatgtatttgatgatttaaaaatgcccaaagcagaaatagttccaaggccctctaacggtacagtaaataaatggaagaaagcttggaatactgaagttaacaacgttttagaagcattcagatttatttatagaagctatttggatttacccaggaacatctgggaattatctttgatgaaggtatacaaattttggaataaattcatcggtgttgctgattacgttagtgaggagacacgagagcctatttcctataagctagatatacaataa

SEQ ID NO: 187 - protein, 563 aa, Saccharomyces cerevisiae
MRLRTAIATLCLTAFTSATSNNSYIATDQTQNAFNDTHFCKVDRNDHVSPSCNVTFNELNAINENIRDDLSALLKSDFFKYFRLDLYKQCSFWDANDGLCLNRACSVDVVEDWDTLPEYWQPEILGSFNNDTMKEADDSDDECKFLDQLCQTSKKPVDIEDTINYCDVNDFNGKNAVLIDLTANPERFTGYGGKQAGQIWSTIYQDNCFTIGETGESLAKDAFYRLVSGFHASIGTHLSKEYLNTKTGKWEPNLDLFMARIGNFPDRVTNMYFNYAVVAKALWKIQPYLPEFSFCDLVNKEIKNKMDNVISQLDTKIFNEDLVFANDLSLTLKDEFRSRFKNVTKIMDCVQCDRCRLWGKIQTTGYATALKILFEINDADEFTKQHIVGKLTKYELIALLQTFGRLSESIESVNMFEKMYGKRLNGSENRLSSFFQNNFFNILKEAGKSIRYTIENINSTKEGKKKTNNSQSHVFDDLKMPKAEIVPRPSNGTVNKWKKAWNTEVNNVLEAFRFIYRSYLDLPRNIWELSLMKVYKFWNKFIGVADYVSEETREPISYKLDIQ

SEQ ID NO: 188 - protein, 8 aa, Artificial Sequence
  EasD cofactor-binding motif
  misc_feature (3)..(5): Xaa can be any naturally occurring amino acid
  misc_feature (7)..(7): Xaa can be any naturally occurring amino acid
TGXXXGXG

SEQ ID NO: 189 - protein, 5 aa, Artificial Sequence
  EasD active site motif
  misc_feature (2)..(4): Xaa can be any naturally occurring amino acid
YXXXK

SEQ ID NO: 190 - protein, 430 aa, Artificial Sequence
  DmaW_consensus sequence No 3
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  misc_feature (8)..(9): Xaa can be any naturally occurring amino acid
  misc_feature (13)..(13): Xaa can be any naturally occurring amino acid
  misc_feature (17)..(18): Xaa can be any naturally occurring amino acid
  misc_feature (24)..(24): Xaa can be any naturally occurring amino acid
  misc_feature (27)..(27): Xaa can be any naturally occurring amino acid
  misc_feature (39)..(39): Xaa can be any naturally occurring amino acid
  misc_feature (47)..(48): Xaa can be any naturally occurring amino acid
  misc_feature (50)..(50): Xaa can be any naturally occurring amino acid
  misc_feature (53)..(53): Xaa can be any naturally occurring amino acid
  misc_feature (72)..(73): Xaa can be any naturally occurring amino acid
  misc_feature (75)..(75): Xaa can be any naturally occurring amino acid
  misc_feature (96)..(96): Xaa can be any naturally occurring amino acid
  misc_feature (98)..(98): Xaa can be any naturally occurring amino acid
  misc_feature (113)..(113): Xaa can be any naturally occurring amino acid
  misc_feature (120)..(120): Xaa can be any naturally occurring amino acid
  misc_feature (124)..(124): Xaa can be any naturally occurring amino acid
  misc_feature (128)..(128): Xaa can be any naturally occurring amino acid
  misc_feature (130)..(132): Xaa can be any naturally occurring amino acid
  misc_feature (134)..(134): Xaa can be any naturally occurring amino acid
  misc_feature (142)..(142): Xaa can be any naturally occurring amino acid
  misc_feature (146)..(146): Xaa can be any naturally occurring amino acid
  misc_feature (151)..(153): Xaa can be any naturally occurring amino acid
  misc_feature (159)..(160): Xaa can be any naturally occurring amino acid
  misc_feature (163)..(163): Xaa can be any naturally occurring amino acid
  misc_feature (166)..(167): Xaa can be any naturally occurring amino acid
  misc_feature (182)..(183): Xaa can be any naturally occurring amino acid
  misc_feature (197)..(197): Xaa can be any naturally occurring amino acid
  misc_feature (207)..(207): Xaa can be any naturally occurring amino acid
  misc_feature (212)..(212): Xaa can be any naturally occurring amino acid
  misc_feature (216)..(218): Xaa can be any naturally occurring amino acid
  misc_feature (223)..(223): Xaa can be any naturally occurring amino acid
  misc_feature (226)..(227): Xaa can be any naturally occurring amino acid
  misc_feature (230)..(230): Xaa can be any naturally occurring amino acid
  misc_feature (233)..(233): Xaa can be any naturally occurring amino acid
  MISC_FEATURE (237)..(258): the stretch of X between amino acid position 237 and 258 can be between 4 X and 12 X
  misc_feature (259)..(259): Xaa can be any naturally occurring amino acid
  misc_feature (262)..(262): Xaa can be any naturally occurring amino acid
  misc_feature (278)..(278): Xaa can be any naturally occurring amino acid
  misc_feature (291)..(291): Xaa can be any naturally occurring amino acid
  misc_feature (293)..(293): Xaa can be any naturally occurring amino acid
  misc_feature (296)..(297): Xaa can be any naturally occurring amino acid
  misc_feature (300)..(300): Xaa can be any naturally occurring amino acid
  misc_feature (307)..(307): Xaa can be any naturally occurring amino acid
  misc_feature (310)..(311): Xaa can be any naturally occurring amino acid
  misc_feature (313)..(313): Xaa can be any naturally occurring amino acid
  misc_feature (316)..(317): Xaa can be any naturally occurring amino acid
  misc_feature (320)..(320): Xaa can be any naturally occurring amino acid
  misc_feature (327)..(327): Xaa can be any naturally occurring amino acid
  misc_feature (330)..(330): Xaa can be any naturally occurring amino acid
  misc_feature (344)..(344): Xaa can be any naturally occurring amino acid
  misc_feature (347)..(347): Xaa can be any naturally occurring amino acid
  misc_feature (363)..(363): Xaa can be any naturally occurring amino acid
  misc_feature (365)..(365): Xaa can be any naturally occurring amino acid
  misc_feature (378)..(379): Xaa can be any naturally occurring amino acid
  misc_feature (382)..(382): Xaa can be any naturally occurring amino acid
  misc_feature (387)..(387): Xaa can be any naturally occurring amino acid
  misc_feature (389)..(390): Xaa can be any naturally occurring amino acid
  misc_feature (395)..(395): Xaa can be any naturally occurring amino acid
  misc_feature (399)..(399): Xaa can be any naturally occurring amino acid
  misc_feature (413)..(413): Xaa can be any naturally occurring amino acid
MXTXNXSXXEVYXTLSXXFDFPNXDQXLWWHSTAPMFAXMLQTANYXXHXQYXHLGIYKKHVIPFLGVYPTXXKXRWLSILTRYGTPFELSLNCSXSXVRYTYEPINAATGTXKDPFNTXAIWXSLQXLXXXQXGIDLEWFXYFKXELTLXXXESAYLXXNNXLVXXQIKTQNKLALDLKGXXFVLKTYIYPALKSXATGKSIHELXFGSVXRLSXXXPSIRXPLXXLEXYVXSRNXXXXXXXXXXXXLSPRLLSCDLXDPXKSRVKIYLLERMVSLXAMEDLWTLGGRRXDXSTXXGLXMIRELWXLLXXPXGLXXYPXPYLPLGXIPXEQLPSMANYTLHHXDPXPEPQVYFTVFGMNDMXVXDALTTFFERRGWXXMAXKYKAXLXXSYPHXDHEXLNYLHAYISFSYRXNKPYLSVYLHSFETGDW

SEQ ID NO: 191 - protein, 566 aa, Artificial Sequence
  EasE_ core consensus sequence
  misc_feature (15)..(15): Xaa can be any naturally occurring amino acid
  misc_feature (17)..(17): Xaa can be any naturally occurring amino acid
  misc_feature (26)..(26): Xaa can be any naturally occurring amino acid
  misc_feature (41)..(41): Xaa can be any naturally occurring amino acid
  misc_feature (44)..(44): Xaa can be any naturally occurring amino acid
  misc_feature (52)..(52): Xaa can be any naturally occurring amino acid
  misc_feature (66)..(66): Xaa can be any naturally occurring amino acid
  misc_feature (76)..(76): Xaa can be any naturally occurring amino acid
  misc_feature (87)..(87): Xaa can be any naturally occurring amino acid
  MISC_FEATURE (88)..(94): the stretch of X between amino acid position 88 and 94 can be between 2 X and 6 X
  misc_feature (112)..(112): Xaa can be any naturally occurring amino acid
  misc_feature (116)..(116): Xaa can be any naturally occurring amino acid
  misc_feature (137)..(137): Xaa can be any naturally occurring amino acid
  misc_feature (158)..(158): Xaa can be any naturally occurring amino acid
  misc_feature (161)..(161): Xaa can be any naturally occurring amino acid
  misc_feature (166)..(166): Xaa can be any naturally occurring amino acid
  MISC_FEATURE (169)..(172): the stretch of X between amino acid position 169 and 172 can be between 1 X and 4 X
  misc_feature (177)..(177): Xaa can be any naturally occurring amino acid
  misc_feature (194)..(194): Xaa can be any naturally occurring amino acid
  misc_feature (198)..(198): Xaa can be any naturally occurring amino acid
  misc_feature (229)..(230): Xaa can be any naturally occurring amino acid
  misc_feature (246)..(246): Xaa can be any naturally occurring amino acid
  misc_feature (296)..(296): Xaa can be any naturally occurring amino acid
  misc_feature (298)..(299): Xaa can be any naturally occurring amino acid
  misc_feature (301)..(301): Xaa can be any naturally occurring amino acid
  misc_feature (307)..(307): Xaa can be any naturally occurring amino acid
  misc_feature (311)..(311): Xaa can be any naturally occurring amino acid
  misc_feature (331)..(334): Xaa can be any naturally occurring amino acid
  misc_feature (343)..(343): Xaa can be any naturally occurring amino acid
  misc_feature (352)..(352): Xaa can be any naturally occurring amino acid
  misc_feature (354)..(354): Xaa can be any naturally occurring amino acid
  misc_feature (357)..(357): Xaa can be any naturally occurring amino acid
  misc_feature (362)..(362): Xaa can be any naturally occurring amino acid
  misc_feature (365)..(365): Xaa can be any naturally occurring amino acid
  misc_feature (368)..(369): Xaa can be any naturally occurring amino acid
  misc_feature (372)..(372): Xaa can be any naturally occurring amino acid
  misc_feature (375)..(375): Xaa can be any naturally occurring amino acid
  misc_feature (379)..(379): Xaa can be any naturally occurring amino acid
  misc_feature (382)..(383): Xaa can be any naturally occurring amino acid
  misc_feature (386)..(386): Xaa can be any naturally occurring amino acid
  misc_feature (389)..(390): Xaa can be any naturally occurring amino acid
  misc_feature (398)..(398): Xaa can be any naturally occurring amino acid
  misc_feature (403)..(403): Xaa can be any naturally occurring amino acid
  misc_feature (411)..(411): Xaa can be any naturally occurring amino acid
  misc_feature (414)..(414): Xaa can be any naturally occurring amino acid
  misc_feature (420)..(420): Xaa can be any naturally occurring amino acid
  misc_feature (424)..(425): Xaa can be any naturally occurring amino acid
  misc_feature (428)..(428): Xaa can be any naturally occurring amino acid
  misc_feature (434)..(434): Xaa can be any naturally occurring amino acid
  misc_feature (451)..(452): Xaa can be any naturally occurring amino acid
  misc_feature (477)..(477): Xaa can be any naturally occurring amino acid
  misc_feature (486)..(486): Xaa can be any naturally occurring amino acid
  misc_feature (490)..(490): Xaa can be any naturally occurring amino acid
  misc_feature (494)..(494): Xaa can be any naturally occurring amino acid
  misc_feature (505)..(505): Xaa can be any naturally occurring amino acid
  misc_feature (528)..(528): Xaa can be any naturally occurring amino acid
  misc_feature (530)..(530): Xaa can be any naturally occurring amino acid
  misc_feature (536)..(536): Xaa can be any naturally occurring amino acid
  misc_feature (557)..(557): Xaa can be any naturally occurring amino acid
CRCRPWESCWPSEEXWXSLNTSIDGXLVRLRPIAHVCHGPXFDXSACDNLLXLSRDSGWRASNPGXLQDWVWEAGXTANESCPVGSXRXXXXXXSCHQGRIPLYSAAVESTXQVQXAVRFARRHNLRLVIRNTGHDXAGRSSAPDSFQIHTHRLQEIXFHXNFRLXGSXXXXTSLGXPAVTVGAGVMMGELYAXGARXGYMVLGGECPTVGVVGGFLQGGGVSSFLSFXXGLAVDNVLEYEVVTAXGELVVANAHQNQDLFWALRGGGGGTFGVVTRATMRVFPDVPVVVSEILLXAXXAXSSFWTXGLSXLLTALQSLNQDNVGGQLVIXXXXKDAVQASIXLFFLNMTEXAXIDXRMKPXLTXLSXXNIXYTXSSKXLPXXSSXLRXXPDIHPDNXYGILXSSVLISQXLFXSSEGPXKVAXXLAXLPMSPXDLLFTSNLGGRVIANGXXELAETSMHPAWRSAAQLINYVRTVXEPSIEGKAXALEXLTNXQMPILYAIDPXFKLSYRNLGDPNEKDFQQVYWGXNXYGRLSXIKKKWDPDDLFFSKLGVGSEXWDSEGMCRK

SEQ ID NO: 192 - protein, 314 aa, Artificial Sequence
  EasC core consensus sequence
  misc_feature (29)..(29): Xaa can be any naturally occurring amino acid
  misc_feature (36)..(36): Xaa can be any naturally occurring amino acid
  misc_feature (48)..(48): Xaa can be any naturally occurring amino acid
  misc_feature (79)..(79): Xaa can be any naturally occurring amino acid
  misc_feature (87)..(87): Xaa can be any naturally occurring amino acid
  misc_feature (90)..(90): Xaa can be any naturally occurring amino acid
  misc_feature (103)..(103): Xaa can be any naturally occurring amino acid
  misc_feature (117)..(117): Xaa can be any naturally occurring amino acid
  misc_feature (128)..(128): Xaa can be any naturally occurring amino acid
  misc_feature (138)..(138): Xaa can be any naturally occurring amino acid
  misc_feature (148)..(148): Xaa can be any naturally occurring amino acid
  misc_feature (185)..(196): Xaa can be any naturally occurring amino acid
  misc_feature (200)..(200): Xaa can be any naturally occurring amino acid
  misc_feature (230)..(230): Xaa can be any naturally occurring amino acid
  misc_feature (247)..(247): Xaa can be any naturally occurring amino acid
  misc_feature (250)..(250): Xaa can be any naturally occurring amino acid
  misc_feature (253)..(254): Xaa can be any naturally occurring amino acid
  misc_feature (259)..(259): Xaa can be any naturally occurring amino acid
  misc_feature (270)..(270): Xaa can be any naturally occurring amino acid
LAHFNREKIPERAVHAKGAGAYGEFEVTXDISDICXIDMLLGVGKKTXCVTRFSTTGLERGSADSVRDLKGMAVKFYTXEGNWDWVXLNXPMFFIRDPSKFPXLIHAQRRDPQTNLXNPSMFWDFVTXNHEALHMVMXQFSDFGTMFXYRSMSGYVGHAYKWVMPDGSFKYVHIFLSSDQGPNFXXXXXXXXXXXXDPDXATRDLYEAIERGEYPSWTANVQVVDPEDAXKLGFNILDVTKHWNLGXYPXDLXXIPSRXFGKLTLNKNPXNYFAEIEQLAFSPSHLVPGVEPSEDPILQARLFAYPDAQRYRLG

The invention claimed is:

1. A recombinant microorganism comprising an exogenous or overexpressed polynucleotide encoding a polypeptide that is capable of converting chanoclavine I to cycloclavine when expressed together with polynucleotides having nucleic acid sequences of SEQ ID NOS: 103, 105, and 108, wherein the exogenous or overexpressed polynucleotide encodes a polypeptide comprising an amino acid sequence that is at least 90% identical to SEQ ID NO: 95.

2. The recombinant microorganism of claim 1 which is not a natural ergot alkaloid producer organism and comprises an exogenous polynucleotide encoding a polypeptide comprising an amino acid sequence that is at least 90% identical to SEQ ID NO: 95.

3. The recombinant microorganism of claim 1, comprising at least one compound selected from the group of compounds consisting of:
   a. Cycloclavine,
   b. Festuclavine,
   c. Agroclavine,
   d. Chanoclavine aldehyde and
   e. Chanoclavine I.

* * * * *